(12) United States Patent
Pedersen et al.

(10) Patent No.: US 12,552,862 B2
(45) Date of Patent: *Feb. 17, 2026

(54) OLIGONUCLEOTIDES FOR REDUCTION OF PD-L1 EXPRESSION

(71) Applicant: HOFFMANN-LA ROCHE INC., Little Falls, NJ (US)

(72) Inventors: Lykke Pedersen, Horsholm (DK); Hassan Javanbakht, Basel (CH); Malene Jackerott, Horsholm (DK); Soren Ottosen, Horsholm (DK); Souphalone Luangsay, Basel (CH)

(73) Assignee: HOFFMANN-LA ROCHE INC., Little Falls, NJ (US)

( * ) Notice: Subject to any disclaimer, the term of this patent is extended or adjusted under 35 U.S.C. 154(b) by 0 days.

This patent is subject to a terminal disclaimer.

(21) Appl. No.: 18/045,109

(22) Filed: Oct. 7, 2022

(65) Prior Publication Data

US 2023/0331837 A1 Oct. 19, 2023

Related U.S. Application Data

(60) Division of application No. 17/000,203, filed on Aug. 21, 2020, now Pat. No. 11,466,081, which is a continuation of application No. 16/839,025, filed on Apr. 2, 2020, now Pat. No. 10,829,555, which is a continuation of application No. 16/664,749, filed on Oct. 25, 2019, now Pat. No. 10,745,480, which is a continuation of application No. 15/458,800, filed on Mar. 14, 2017, now abandoned.

(30) Foreign Application Priority Data

Mar. 14, 2016 (EP) ..................................... 16160149

(51) Int. Cl.
| | |
|---|---|
| *C07K 16/28* | (2006.01) |
| *A61K 38/17* | (2006.01) |
| *A61K 39/39* | (2006.01) |
| *A61K 39/395* | (2006.01) |
| *C12N 15/113* | (2010.01) |
| *A61K 39/00* | (2006.01) |
| *A61K 45/06* | (2006.01) |

(52) U.S. Cl.
CPC .......... *C07K 16/28* (2013.01); *A61K 38/1709* (2013.01); *A61K 39/39* (2013.01); *A61K 39/39558* (2013.01); *C12N 15/1138* (2013.01); *A61K 2039/505* (2013.01); *A61K 2039/55516* (2013.01); *A61K 2039/572* (2013.01); *A61K 45/06* (2013.01); *C07K 2317/70* (2013.01); *C12N 2310/11* (2013.01); *C12N 2310/315* (2013.01); *C12N 2310/3231* (2013.01); *C12N 2310/341* (2013.01); *C12N 2310/346* (2013.01); *C12N 2310/351* (2013.01); *G01N 2800/26* (2013.01); *Y02A 50/30* (2018.01)

(58) Field of Classification Search
None
See application file for complete search history.

(56) References Cited

U.S. PATENT DOCUMENTS

| | | |
|---|---|---|
| 4,587,044 A | 5/1986 | Miller et al. |
| 4,667,025 A | 5/1987 | Miyoshi et al. |
| 4,948,882 A | 8/1990 | Ruth |
| 5,112,963 A | 5/1992 | Pieles et al. |
| 5,245,022 A | 9/1993 | Weis et al. |
| 5,254,469 A | 10/1993 | Warren et al. |
| 5,391,723 A | 2/1995 | Priest |
| 5,486,603 A | 1/1996 | Buhr |
| 5,510,475 A | 4/1996 | Agrawal et al. |
| 5,512,667 A | 4/1996 | Reed et al. |
| 5,525,465 A | 6/1996 | Haralambidis et al. |
| 5,541,313 A | 7/1996 | Ruth |
| 5,545,730 A | 8/1996 | Urdea et al. |
| 5,552,538 A | 9/1996 | Urdea et al. |
| 5,574,142 A | 11/1996 | Meyer et al. |
| 5,580,731 A | 12/1996 | Chang et al. |
| 5,608,046 A | 3/1997 | Cook et al. |
| 5,684,142 A | 11/1997 | Mishra et al. |
| 5,770,716 A | 6/1998 | Khan et al. |
| 5,885,968 A | 3/1999 | Biessen et al. |
| 5,994,517 A | 11/1999 | Ts et al. |
| 6,096,875 A | 8/2000 | Khan et al. |

(Continued)

FOREIGN PATENT DOCUMENTS

| | | |
|---|---|---|
| CN | 101084438 A | 12/2007 |
| CN | 104479018 | 4/2015 |

(Continued)

OTHER PUBLICATIONS

Langer, R, "New Methods of Drug Delivery," Science, 1990, vol. 249, pp. 1527-1533, 7 pages.

Mangos et al., "Efficient RNase H-directed cleavage of RNA promoted by antisense DNA or 2'F-ANA constructs containing acyclic nucleotide inserts," J. Am. Chem. Soc., Jan. 22, 2003, 125(3):654-661.

Manoharan, "Oligonucleotide Conjugates as Potential Antisense Drugs with Improved Uptake, Biodistribution, Targeted Delivery, and Mechanism of Action," Antisense and Nucleic Acid Drug Development, Jul. 8, 2004, 12(2):103-128.

(Continued)

*Primary Examiner* — Ekaterina Poliakova-Georgantas
(74) *Attorney, Agent, or Firm* — McDonnell Boehnen Hulbert & Berghoff LLP

(57) ABSTRACT

The present invention relates to antisense oligonucleotides that are capable of reducing expression of PD-L1 in a target cell. The oligonucleotides hybridize to PD-L1 mRNA. The present invention further relates to conjugates of the oligonucleotide and pharmaceutical compositions and methods for treatment of viral liver infections such as HBV, HCV and HDV; parasite infections such as malaria, toxoplasmosis, leishmaniasis and trypanosomiasis or liver cancer or metastases in the liver using the oligonucleotide.

10 Claims, 17 Drawing Sheets

Specification includes a Sequence Listing.

(56) References Cited

U.S. PATENT DOCUMENTS

| | | |
|---|---|---|
| 6,335,432 B1 | 1/2002 | Segev |
| 6,335,437 B1 | 1/2002 | Manoharan |
| 8,507,663 B2 | 8/2013 | Defougerolles et al. |
| 10,745,480 B2 | 8/2020 | Pedersen et al. |
| 10,829,555 B2 | 11/2020 | Pedersen et al. |
| 10,982,215 B2 | 4/2021 | Hinkle |
| 11,021,503 B2 | 6/2021 | Breitler et al. |
| 11,466,081 B2 | 10/2022 | Pedersen et al. |
| 2002/0147332 A1 | 10/2002 | Kaneko et al. |
| 2006/0083744 A1 | 4/2006 | Chen et al. |
| 2007/0083334 A1 | 4/2007 | Mintz et al. |
| 2010/0151492 A1 | 6/2010 | Ahmed et al. |
| 2011/0251259 A1 | 10/2011 | Defougerolles et al. |
| 2011/0318839 A1 | 12/2011 | Shiku et al. |
| 2012/0122801 A1 | 5/2012 | Platenburg |
| 2014/0242101 A1 | 8/2014 | Andersen |
| 2014/0288153 A1 | 9/2014 | Collard et al. |
| 2015/0159160 A1 | 6/2015 | Krieg et al. |
| 2015/0197540 A1 | 7/2015 | Shimizu et al. |
| 2015/0232836 A1 | 8/2015 | Krieg et al. |
| 2017/0283496 A1 | 10/2017 | Pedersen et al. |
| 2019/0309065 A1 | 10/2019 | Freeman et al. |
| 2021/0147535 A1 | 5/2021 | Javanbakht et al. |

FOREIGN PATENT DOCUMENTS

| | | |
|---|---|---|
| CN | 104583401 A | 4/2015 |
| CN | 104955952 A | 9/2015 |
| CN | 108779465 | 11/2018 |
| EP | 1495769 A1 | 1/2005 |
| EP | 1537878 A1 | 6/2005 |
| EP | 2361921 A2 | 8/2011 |
| EP | 2404997 A1 | 1/2012 |
| EP | 2734208 B1 | 3/2017 |
| EP | 3377510 B1 | 12/2020 |
| EP | 3430141 B1 | 12/2020 |
| JP | 2008-515442 A | 5/2008 |
| JP | 2008-543774 A | 12/2008 |
| JP | 2012-510619 A | 5/2012 |
| JP | 2013-523162 A | 6/2013 |
| JP | 2014-210793 A | 11/2014 |
| JP | 20210212541 | 12/2021 |
| JP | 7447073 | 3/2024 |
| RU | 2123528 C1 | 12/1998 |
| WO | 93/07883 A1 | 4/1993 |
| WO | 96/11205 A1 | 4/1996 |
| WO | 98/39352 A1 | 9/1998 |
| WO | 98/52614 A2 | 11/1998 |
| WO | 99/14226 A2 | 3/1999 |
| WO | 99/65925 A1 | 12/1999 |
| WO | 00/47599 A1 | 8/2000 |
| WO | 00/66604 A2 | 11/2000 |
| WO | 01/23613 A1 | 4/2001 |
| WO | 2004/046160 A2 | 6/2004 |
| WO | 2005/007855 A2 | 1/2005 |
| WO | 2005/014806 A2 | 2/2005 |
| WO | 2006042237 A2 | 4/2006 |
| WO | 2006133396 A2 | 12/2006 |
| WO | 2007/031091 A2 | 3/2007 |
| WO | 2007/084865 A2 | 7/2007 |
| WO | 2007/090071 A2 | 8/2007 |
| WO | 2007/134181 A2 | 11/2007 |
| WO | 2007/146511 A2 | 12/2007 |
| WO | 2008/113832 A2 | 9/2008 |
| WO | 2008/150729 A2 | 12/2008 |
| WO | 2008/154401 A2 | 12/2008 |
| WO | 2009/006478 A2 | 1/2009 |
| WO | 2009/067647 A1 | 5/2009 |
| WO | 2009/090182 A1 | 7/2009 |
| WO | 2009/124238 A1 | 10/2009 |
| WO | 2009/126933 A2 | 10/2009 |
| WO | 2010/036698 A1 | 4/2010 |
| WO | 2010063011 A2 | 6/2010 |
| WO | 2010/077578 A1 | 7/2010 |
| WO | WO2010077634 | 7/2010 |
| WO | 2010/101249 A1 | 9/2010 |
| WO | 2010/129799 A2 | 11/2010 |
| WO | 2011/017521 A2 | 2/2011 |
| WO | 2011/127180 A1 | 10/2011 |
| WO | WO2011143762 | 11/2011 |
| WO | 2011/156202 A1 | 12/2011 |
| WO | 2012/024170 A2 | 2/2012 |
| WO | 2012/055362 A1 | 5/2012 |
| WO | 2012/083046 A2 | 6/2012 |
| WO | 2012/089352 A1 | 7/2012 |
| WO | 2012/145697 A1 | 10/2012 |
| WO | 2013/003520 A1 | 1/2013 |
| WO | 2013/012758 A1 | 1/2013 |
| WO | 2013/033230 A1 | 3/2013 |
| WO | 2013/036868 A1 | 3/2013 |
| WO | 2013/049307 A2 | 4/2013 |
| WO | 2013/154798 A1 | 10/2013 |
| WO | 2013/159109 A1 | 10/2013 |
| WO | 2013/173598 A1 | 11/2013 |
| WO | 2014/076195 A1 | 5/2014 |
| WO | 2014/076196 A1 | 5/2014 |
| WO | 2014/083178 A1 | 6/2014 |
| WO | 2014/118267 A1 | 8/2014 |
| WO | 2014/118272 A1 | 8/2014 |
| WO | 2014/179620 A1 | 11/2014 |
| WO | 2014/179629 A2 | 11/2014 |
| WO | 2014/207232 A1 | 12/2014 |
| WO | 2015/114146 A1 | 8/2015 |
| WO | 2016/025647 A1 | 2/2016 |
| WO | 2016/055601 A1 | 4/2016 |
| WO | 2016/138278 A2 | 9/2016 |
| WO | 2016/180784 A1 | 11/2016 |
| WO | 2017/055423 A1 | 4/2017 |
| WO | 2017/084987 A1 | 5/2017 |
| WO | 2017/100587 A1 | 6/2017 |
| WO | 2017/157899 A | 11/2018 |

OTHER PUBLICATIONS

Krieg et al., "Uptake of oligodeoxyribonucleotides by lymphoid cells is heterogeneous and inducible," Antisense Research and Development, 1991, 1(2):161-171.

Jobst et al., "Selective sugar binding to the carbohydrate recognition domains of the rat hepatic and macrophage asialoglycoprotein receptors," J Biol Chem, Mar. 22, 1996, 271(12):6686-6693.

Japanese Patent Office, "Office Action," issued in connection with Japanese Patent Application No. 2021212541 dated Feb. 28, 2023 (7 pages) (4 pages of English Translation and 3 pages of Original Document).

Holdgate, GA et al., "Measurements of binding thermodynamics in drug discovery," Drug Discovery Today, 2005, vol. 10, No. 22, pp. 1543-1550, 8 pages.

Mazanet, M. M., et al., "B7-H1 Is Expressed by Human Endothelial Cells and Suppresses T Cell Cytokine Synthesis", The Journal of Immunology, vol. 169, No. 7, 2002, pp. 3581-3588.

McTigue PM et al. "Sequence-Dependent Thermodynamic Parameters for Locked Nucleic Acid (LNA)-DNA Duplex Formation," Biochemistry, 2004, vol. 43(18), pp. 5388-5405, 18 pages.

Mergny, JL et al., "Analysis of Thermal Melting Curves," Oligonucleotides, 2003, vol. 13, pp. 515-537, 23 pages.

Hirao, I. et al., "Natural versus Artificial Creation of Base Pairs in DNA: Origin of Nucleobases from the Perspectives of Unnatural Base Pair Studies," Accounts of Chemical Research, 2012, vol. 45, No. 12, pp. 2055-2065, 11 pages.

Mitsuoka et al., "A bridged nucleic acid, 2',4'-BNA COC: synthesis of fully modified oligonucleotides bearing thymine, 5-methylcytosine, adenine and guanine 2',4'-BNA COC monomers and RNA-selective nucleic-acid recognition," Nucleic Acids Research, Mar. 2009, 37(4):1225-1238.

Hansen, LD et al., Entropy Titration. A Calorimetric Method for the Determination of .DELTA.G.degree.(K), .DELTA.H.degree. and DELTA.S.degree. , Chemical Communications, 1965, pp. 36-38, 3 pages.

Morita K et al., "2'-O,4'-C-Ethylene-Bridged Nucleic Acids (ENA): Highly Nuclease-Resistant and Thermodynamically Stable Oligo-

(56) References Cited

OTHER PUBLICATIONS nucleotides for Antisense Drug," Bioorganic & Medicinal Chemistry Letters, 2002, vol. 12, pp. 73-76, 4 pages.
Nayersina R et al., "HLA A2 restricted cytotoxic T lymphocyte responses to multiple hepatitis B surface antigen epitopes during hepatitis B virus infection," Journal of Immunology, (1993), vol. 150(10), pp. 4659-4671, 14 pages.
Gutierrez et al. "Regulation of Trypanosoma cmzi-induced myocarditis by programmed death cell receptor I," Infectimmun, May 2011, 79(5):1873-1881.
Freier et al., "The ups and downs of nucleic acid duplex stability: structure-stability studies on chemically-modified DNA:RNA duplexes," Nucl. Acid Res., Nov. 15, 1997, 25(22):4429-4443.
Flutter, K et al., "Filling the gap in LNA antisense oligo gapmers: the effects of unlocked nucleic acid (UNA) and 4'C.:-hydroxymethyl-DNA modifications on RNase H recruitment and efficacy of an LNA gapmer," Molecular Biosystems, 2009, vol. 5, issue 8, pp. 838-843, 6 pages.
European Patent Office, "Office Action," issued in connection with European Patent Application No. 20201780.2 dated Sep. 27, 2021 (4 pages).
European Patent Office, "Office Action," issued in connection with European Patent Application No. 17710874.3 dated Jan. 22, 2020 (5 pages).
Official Letter issued in Colombia Patent Application No. NC2020/0010348 on May 3, 2021, 7 pgs.
Pajot A et al., "A mouse model of human adaptive immune functions: HLA-A2.1-/HLA-DR1-transgenic H-2 class I-/class II-knockout mice," Eur Journal of Immunology, 2004, vol. 34, pp. 3060-3069, 10 pages.
European Patent Office, "European search report," issued in connection with European Patent Application No. 20201780.2 dated Jan. 25, 2021 (8 pages).
Duff, et al., "Intrabody tissue-specific delivery of antisense conjugates in animals: ligand-linker-antisense oligomer conjugates," Methods Enzvmol, Dec. 31, 2000, 313:297-321.
Deleavey, GE et al., "Designing Chemically Modified Oligonucleotides for Targeted Gene Silencing," Chemistry and Biology, 2012, vol. 19(8), pp. 937-954, 18 pages.
Claims of Chilean Patent Application No. 20200865, filed Jun. 10, 2020, 5 pgs.
Rukov et al., "Dissecting the target specificity of RNase H recruiting oligonucleotides using massively parallel reporter analysis of short RNA motifs," Nucl. Acids Res, Sep. 30, 2015, 43(17):8476-8487.
Chilean Patent Application No. 20200865, filed Mar. 31, 2020, 685 pgs.
Santa Lucia, JJr., "A unified view of polymer, dumbbell, and oligonucleotide DNA nearest-neighborthermodynamics," Proc Nall Acad Sci USA, 1998, 95(4), pp. 1460-1465, 6 pages.
SantaLucia, Jr., "A unified view of polymer, dumbbell, and oligonucleotide DNA nearest-neighbor thermodynamics," Proc Natl Acad Sci USA, Feb. 17, 1998, 95(4):1460-1465.
Seth, PP et al., "Synthesis and Biophysical Evaluation of 2',4'-Constrained 2'O-Methoxyethyl and 2',4'-Constrained 2' O-Ethyl Nucleic Acid Analogues," J. Org. Chem., 2010, vol. 75, No. 5, pp. 1569-1581, 7 pages.
Sette, A et al., "The Relationship Between Class I Binding Affinity and Immunogenicity of Potential Cytotoxic T Cell Epitopes," Journal of Immunology, 1994, pp. 5586-5592, 7 pages.
Chilean Patent Application No. 201802570, abstract, 3 pages.
Caruthers, MH et al., "Chemical Synthesis of Deoxyoligonucleotides by the Phosphoramidite Method," Methods in Enzymology, 1987, vol. 154:15, pp. 287-313, 27 pages.
Sugimoto, N. et al., "Thermodynamic Parameters to Predict Stability of RNA/DNA Hybrid Duplexes," Biochemistry, 1995, vol. 34(35), pp. 11211-11216, 6 pages.
Tupin E et al., "Activation of Natural Killer T Cells by Glycolipids," Methods in Enzymol., 2006, vol. 417, pp. 185-201, 17 pages.

Uhlmann E, "Recent advances in the medicinal chemistry of antisense olignonucleotides," Current Opinion in Drug Development, 2000, vol. 3(2), pp. 203-213, 12 pages.
Vester B et al., "Chemically modified oligonucleotides with efficient RNase H response," Bioorganic & Medicinal chemistry Letters, 2008, vol. 18, pp. 2296-2300, 5 pages.
Wykes et al., "Malaria drives T cells to exhaustion," Front Microbiol, May 27, 2014, 5:249.
Breton et al., "siRNA knockdown, 11 of PD-L1 and PD-L2 in monocyte-derived dendrilic cells only modestly improves proliferative responses to Gag by CD8(+) T cells from HIV-1-infected individuals.", J Clin Immunol, (Sep. 2009), vol. 29, No. 5, pp. 637-645.
Yang et al., "A mouse model for HBV immunotolerance and immunotherapy," Cellular & Molecular Immunology, Jan. 2014, 11(1):71-78.
Biessen et al., "Targeted delivery of oligodeoxynucleotides to parenchymal liver cells in vivo," Biochem J., Jun. 15, 1999, 340 (pt 3):783-792.
Biessen et al., "Synthesis of Cluster Galactosides with High Affinity for the Hepatic AsialoglycoproteinReceptor," J. Med. Chem., Apr. 28, 1995, 38(9):1538-1546.
Bertoletti et al., "Different Cytokine Profiles of Intrahepatic T Cells in Chronic Hepatitis B and Hepatitis C Vims Infections," Gastroenterology, Jan. 1997;112(1):193-199.
Bergstrom DE, "Unnatural nucleosides with unusual base pairing properties", Current Protocols in Nucleic Acid Chemistry, 2009, Suppl. 37 1.4.1, 32 pgs.
Berge etal, Pharmaceutical Salts, Journal of Pharmaceutical Sciences, 1977, vol. 66, No. 1, pp. 1-19 (Year: 1977).
Barber et al., "Restoring function in exhausted CDS T cells during chronic viral infection," Nature, Feb. 9, 2006, 439:682-687, 13 pages.
Asseline, et al., "Nucleic acid-binding molecules with high affinity and base sequence specificity: Intercalating agents covalently linked to oligodeoxynucleotides," Proc. Natl. Acad. Sci. USA, Jun. 1984, 81:3297-3301.
"International Search Report and Written Opinion of the International Searching Authority," issued in connection with Int'l Appl. No. PCT/EP2017/055925, dated Jun. 8, 2017 (12 pages).
Breton, G. SiRNA knockdown of PD-L1 and PD-L2 in monocyte-derived dendritic cells only modestly improves proliferative responses to Gag by CD8+ T Cells from HIV-1 infected individuals, J Clin Immunol, 2009, 29(5), pp. 637-645.
Mazanet, M. M. et al. B7-H1 is Expressed by Human Endothelial Cells and Suppresses T Cell Cytokine Synthesis, J Immunology, 2002, vol. 169, No. 7, pp. 3581-3588.
Bhadra et al., "Control of Toxoplasma reactivation by rescue of dysfunctional CD8+ T-cell response via PD-1-PDL-1 blockade," Proc Natl Acad Sci USA, May 31, 2011, 108(22):9196-9201.
Bhadra et al., "PD-1-mediated attrition of polyfunctional memory CD8+ T cells in chronic toxoplasma infection," JInfectDis, Jul. 2012, 206(1):125-134.
Dion et al., "Adeno-associated virus-mediated gene transfer leads to persistent hepatitis B virus replication in mice expressing HLA-A2 and HLA-DRI molecules," J Virol, May 2013, 87(10):5554-5563.
Dolina et al., "Lipidoid Nanoparticles Containing PD-LI siRNA Delivered In Vivo Enter Kupffer Cells and Enhance NK and CD8+ T Cell-mediated Hepatic Antiviral Immunity," Molecular Therapy-Nucleic Acids, Feb. 19, 2013, 2:e72.
Esch et al., "Programmed death 1-mediated T cell exhaustion during visceral leishmaniasis impairs phagocyte function," J Immunol, Dec. 1, 2013, 191(11):5542-5550.
Freeman et al., "A new therapeutic strategy for malaria: targeting T cell exhaustion," Nat Immunol, Jan. 19, 2012, 13(2):113-115.
Joshi et al., "B7-HI Blockade Increases Survival of Dysfunctional CD8+ T Cells and Confers Protection against Leishmania donovani Infections," PLoS Pathog, May 15, 2009, 5(5):e1000431.
Kapoor et al., "Strategies to eliminate HBV infection," Future Virol, 2014, 9(6):565-585.
Liang et al., "PD-LI and PD-L2 have distinct roles in regulating host immunity to cutaneous leishmaniasis," Eur J Immunol, Jan. 2006, 36(1):58-64.

(56) References Cited

OTHER PUBLICATIONS

Loirat et al., "Multiepitopic HLA-A*020 !-restricted immune response against hepatitis B surface antigen after DNA-based immunization," J Immunol, Oct. 15, 2000, 165(8):4748-4755.
Maier et al., "PD-I:PD-LI interactions contribute to the functional suppression of virus-specific CD8+ T lymphocytes in the liver," J. Immunol., Mar. 1, 2007, 178(5):2714-2720.
Michel et al., "DNA-mediated immunization to the hepatitis B surface antigen in mice: aspects of the humoral response mimic hepatitis B viral infection in humans," Proc Natl Acad Sci USA, Jun. 6, 1995, 92(12):5307-5311.
Mizukoshi et al., "Cellular immune responses to the hepatitis B virus polymerase," J Immunol, Nov. 1, 2004, 173(9):5863-5871.
Rehermann et al., "The cytotoxic T lymphocyte response to multiple hepatitis B virus polymerase epitopes during and after acute viral hepatitis," J Exp Med, Mar. 1, 1995, 181(3):1047-1058.
Salem et al., "Programmed death-1/programmed death-LI signaling pathway and its blockade in hepatitis C virus immunotherapy," World J Hepatol, Oct. 18, 2015, 7(23):2449-2458.
Yang N et al., "HPMA polymer-based site-specific delivery of oligonucleotides to hepatic stellate cells," Bioconjug Chem, Feb. 2009, 20(2):213-221.
Yi et al., "T-cell exhaustion: characteristics, causes and conversion," Immunology, Apr. 2010, 129(4):474-481.
Yu R Z et al., "Disposition and Pharmacology of a GalNAc3-conjugated ASO Targeting Human Lipoprotein (a) in Mice," Molecular Therapy Nucleic Acids, Jan. 2016, vol. 5, E317.
Prakash T P et al., "Targeted delivery of antisense oligonucleotides to hepatocytes using triantennary N-acetyl galactosamine improves potency 10-fold in mice," Nucleic Acids Research, 2014, vol. 42, issue 13, pp. 8796-8807.
European Patent Application No. 15194811.4 filed Nov. 16, 2015,44 pgs.
Biessen et al., Receptro-dependent cell specific delivery of antisense oligonucleotides, Developments in Cardovascular Medicine, 1999, vol. 214, pp. 285-300.
GenBankAccession No. NM_014143, "*Homo sapiens* CD274 molecule (CD274), transcriptvariant 1, mRNA," Mar. 15, 2015, 9 pages.
GenBank Accession No. NM_021893, "Mus musculus CD274 antigen (Cd274), mRNA," Feb. 15, 2015, 8 pages.
GenBank Accession No. XM_005581779, "Predicted: Macaca fascicularis CD274 molecule (CD274), transcript variant XI, mRNA," Sep. 19, 2013, 5 pages.
Gennaro A R et al., Remington's Pharmaceutical Sciences, Mack Publishing Company, Philadelphia, Pa., 17th ed., 1985.
Glen Research Catalogue No. 10-1920-xx downloaded Mar. 21, 2018.
Glen Research Catalogue No. 10-1922-xx downloaded Mar. 21, 2018.
Glen Research Catalogue No. 10-1925-xx downloaded Mar. 21, 2018.
Hangeland et al., "Cell-type specific and ligand specific enhancement of cellular uptake of oligodeoxynucleoside methylphosphonates covalently linked with a neoglycopeptide, YEE(ah-GalNAc)3," Bioconjug Chem., Nov.-Dec. 1995, 6(6):695-701.
Enquiry under Substantive Examination issued in Russian Patent Application No. 2018134379, mailed Jun. 22, 2020, 8 pgs.
Maier et al., "Synthesis of antisense oligonucleotides conjugated to a multivalent carbohydrate cluster for cellular targeting," Bioconjug Chem, Jan.-Feb. 2003, 14(1):18-29.
Manoharan, M., Designer Antisense Oligonucleotides: Conjugation Chemistry and Functionality Placement, in Crooke S T and Lebleu B (eds) Antisense Research and Applications, CRC Press, Boca Raton, Fla., 1993, pp. 303-350.
Manoharan, M., "Oligonucleotide Conjugates in Antisense Technology," Antisense Drug Technology, Marcel Dekker, Inc., 2001, Ch. 16, pp. 391-469, 81 pages.
Manoharan: Antisense Drug Technology, Principles, Strategies, and Applications, Marcel Dekker Inc, 2001.
Matsuda S et al., "siRNA Conjugates carring sequentially assembled trivalent N-Acetylgalactosamine linked through nucleosides elicit robust gene silencing in vivo in hepatocytes," ACS Chem Biol 2015, vol. 10, No. 5, pp. 1181-1187 (doi.org/10.1021/cb501028c).
Notice of Allowance issued in Korean Patent Application No. 10-2018-7026546, mailed Jun. 20, 2021, 3 pgs.
Office Action issued in Argentine Patent Application No. 20170100626 on Oct. 7, 2020, 5 pgs.
Office Action issued in Russian Patent Application No. 2018134379, mailed Jun. 23, 2020, 6 pgs (English Translation).
Office Action received for Taiwan Patent Application No. 109135755, mailed on Oct. 25, 2021, 6 pages (3 pages of English Translation and 3 pages of original document).
Xu et al., "Effective small interfering RNAs and phosphorothioate antisense DNAs have different preferences for target sites in the luciferase mRNAs," Biochem. Biophys. Res. Comm., Jul. 4, 2003, 306(3):712-717.
Zatsepin et al., "Synthesis and applications of oligonucleotide-carbohydrate conjugates," Chem Biodivers, Oct. 2004, 1(10): 1401-1417.
Chilean application No. CL202001126 filed Apr. 28, 2020, pp. 1-683.
Chilean application No. 17. CL202001127 filed Apr. 28, 2020, pp. 1-682.

C

D

E

CMP ID NO 766_2

CMP ID NO 767_2

CMP ID NO 768_2

CMP ID NO 769_2

CMP ID NO 770_2

OLIGONUCLEOTIDES FOR REDUCTION OF PD-L1 EXPRESSION

CROSS-REFERENCE TO RELATED APPLICATIONS

This application is a continuing application of U.S. patent application Ser. No. 17/000,203, filed Aug. 21, 2020, which is a continuation of U.S. patent application Ser. No. 16/839, 025, filed Apr. 2, 2020, issued as U.S. Pat. No. 10,829,555, which is a continuation of U.S. patent application Ser. No. 16/664,749, filed Oct. 25, 2019, issued as U.S. Pat. No. 10,745,480, which is a continuation of U.S. patent application Ser. No. 15/458,800, filed Mar. 14, 2017, now abandoned, which claims priority to European Patent Application No. 16160149.7, filed Mar. 14, 2016, the entire contents of which are hereby incorporated by reference.

SEQUENCE LISTING

The content of the Sequence Listing submitted electronically herewith (name: 2020.08.21 Parent_Sequence Listing.txt); size 372.883 bytes; and date of creation: Oct. 5, 2022) is hereby incorporated by reference in its entirety.

REFERENCE TO AN ELECTRONIC SEQUENCE LISTING

The instant application contains a Sequence Listing which has been submitted electronically in XML format and is hereby incorporated by reference in its entirety. The name of the XML file is "P118868US1MMM_ST26." The XML file is $9.7 \times 10^6$ bytes (9.7 Megabytes) in size and was created on Jun. 29, 2023. The XML file contains no new matter.

FIELD OF INVENTION

The present invention relates to oligonucleotides (oligomers) that are complementary to programmed death ligand-1 (PD-L1), leading to reduction of the expression of PD-L1 the liver. The present invention also relates to a method of alleviating the T cell exhaustion caused by an infection of the liver or cancer in the liver. Relevant infections are chronic HBV, HCV and HDV and parasite infections like malaria and toxoplasmosis (e.g. caused by protozoa of the *Plasmodium*, in particular of the species *P. vivax, P. malariae* and *P. falciparum*).

BACKGROUND

The costimulatory pathway consisting of the programmed death-1 (PD-1) receptor and its ligand, PD-L1 (or B7-H1 or CD274) is known to contribute directly to T cell exhaustion resulting in lack of viral control during chronic infections of the liver. The PD-1 pathway also plays a role in autoimmunity as mice disrupted in this pathway develop autoimmune diseases.

It has been shown that antibodies that block the interaction between PD-1 and PD-L1 enhance T cell responses, in particular the response of CD8+ cytotoxic T cells (see Barber et al 2006 Nature Vol 439 p682 and Maier et al 2007 J. Immunol. Vol 178 p 2714).

WO 2006/042237 describes a method of diagnosing cancer by assessing PD-L1 (B7-H1) expression in tumors and suggests delivering an agent, which interferes with the PD-1/PD-L1 interaction, to a patient. Interfering agents can be antibodies, antibody fragments, siRNA or antisense oligonucleotides. There are no specific examples of such interfering agents nor is there any mentioning of chronic liver infections.

RNA interference mediated inhibition of PD-L1 using double stranded RNA (dsRNA, RNAi or siRNA) molecules have also been disclosed in for example WO 2005/007855, WO 2007/084865 and U.S. Pat. No. 8,507,663. None of these describes targeted delivery to the liver.

Dolina et al. 2013 Molecular Therapy-Nucleic Acids, 2 e72 describes in vivo delivery of PD-L1 targeting siRNA molecules to Kupffer cells thereby enhancing NK and CD8+ T cell clearance in MCMV infected mice. This paper concludes that PD-L1 targeting siRNA molecules delivered to hepatocytes are not effective in relation to enhancing CD8+ T cell effector function.

The siRNA approach is significantly different from the single stranded antisense oligonucleotide approach since the biodistribution and the mode of actions is quite different. As described in Xu et al 2003 Biochem. Biophys. Res. Comm. Vol 306 page 712-717, antisense oligonucleotides and siRNAs have different preferences for target sites in the mRNA.

WO2016/138278 describes inhibition of immune checkpoints including PD-L1, using two or more single stranded antisense oligonucleotides that are linked at their 5' ends. The application does not mention HBV or targeted delivery to the liver.

OBJECTIVE OF THE INVENTION

The present invention identifies novel oligonucleotides and oligonucleotide conjugates which reduce PD-L1 mRNA very efficiently in liver cells, both in parenchymal cells (e.g. hepatocytes) and in non-parenchymal cells such as Kupffer cells and liver sinusoidal endothelial cells (LSECs). By reducing or silencing PD-L1, the oligonucleotides and oligonucleotide conjugates decrease PD-1-mediated inhibition and thereby promote immunostimulation of exhausted T cells. Alleviation of the T cell exhaustion in a chronic pathogenic infection of the liver will result in regained immune control and reduced levels of viral antigens in the blood during a chronic pathogenic infection of the liver. Natural killer (NK) cells and natural killer T (NKT) cells may also be activated by the oligonucleotides and oligonucleotide conjugates of the present invention.

The oligonucleotide conjugates secures local reduction of PD-L1 in liver cells and therefore reduces the risk of autoimmune side effects, such as pneumonitis, non-viral hepatitis and colitis associated with systemic depletion of PD-L1.

SUMMARY OF INVENTION

The present invention relates to oligonucleotides or conjugates thereof targeting a nucleic acid capable of modulating the expression of PD-L1 and to treat or prevent diseases related to the functioning of the PD-L1. The oligonucleotides or oligonucleotide conjugates may in particular be used to treat diseases where the immune response against an infectious agent has been exhausted.

Accordingly, in a first aspect the invention provides oligonucleotides which comprise a contiguous nucleotide sequence of 10 to 30 nucleotides in length with at least 90% complementarity to a PD-L1 target nucleic acid. The oligonucleotide can be an antisense oligonucleotide, preferably with a gapmer design. Preferably, the oligonucleotide is capable of inhibiting the expression of PD-L1 by cleavage of a target nucleic acid. The cleavage is preferably achieved via nuclease recruitment.

In a further aspect, the oligonucleotide is conjugated to at least one asialoglycoprotein receptor targeting conjugate moiety, such as a conjugate moiety comprising at least one N-Acetylgalactosamine (GalNAc) moiety. The conjugation moiety and the oligonucleotide may be linked together by a linker, in particular a biocleavable linker.

In a further aspect, the invention provides pharmaceutical compositions comprising the oligonucleotides or oligonucleotide conjugates of the invention and pharmaceutically acceptable diluents, carriers, salts and/or adjuvants.

In a further aspect, the invention provides methods for in vivo or in vitro method for reduction of PD-L1 expression in a target cell which is expressing PD-L1, by administering an oligonucleotide or composition of the invention in an effective amount to said cell.

In a further aspect, the invention provides oligonucleotides, oligonucleotide conjugates or pharmaceutical compositions for use in restoration of immunity against a virus or parasite.

In a further aspect, the invention provides oligonucleotides, oligonucleotide conjugates or pharmaceutical compositions for use as a medicament.

In a further aspect the invention provides methods for treating or preventing a disease, disorder or dysfunction by administering a therapeutically or prophylactically effective amount of the oligonucleotide of the invention to a subject suffering from or susceptible to the disease, disorder or dysfunction, in particular diseases selected from viral liver infections or parasite infections.

In a further aspect the oligonucleotide, oligonucleotide conjugates or pharmaceutical composition of the invention is used in the treatment or prevention of viral liver infections such as HBV, HCV and HDV or a parasite infections such as malaria, toxoplasmosis, leishmaniasis and trypanosomiasis or liver cancer or metastases in the liver.

DEFINITIONS

Oligonucleotide

Figure 1:
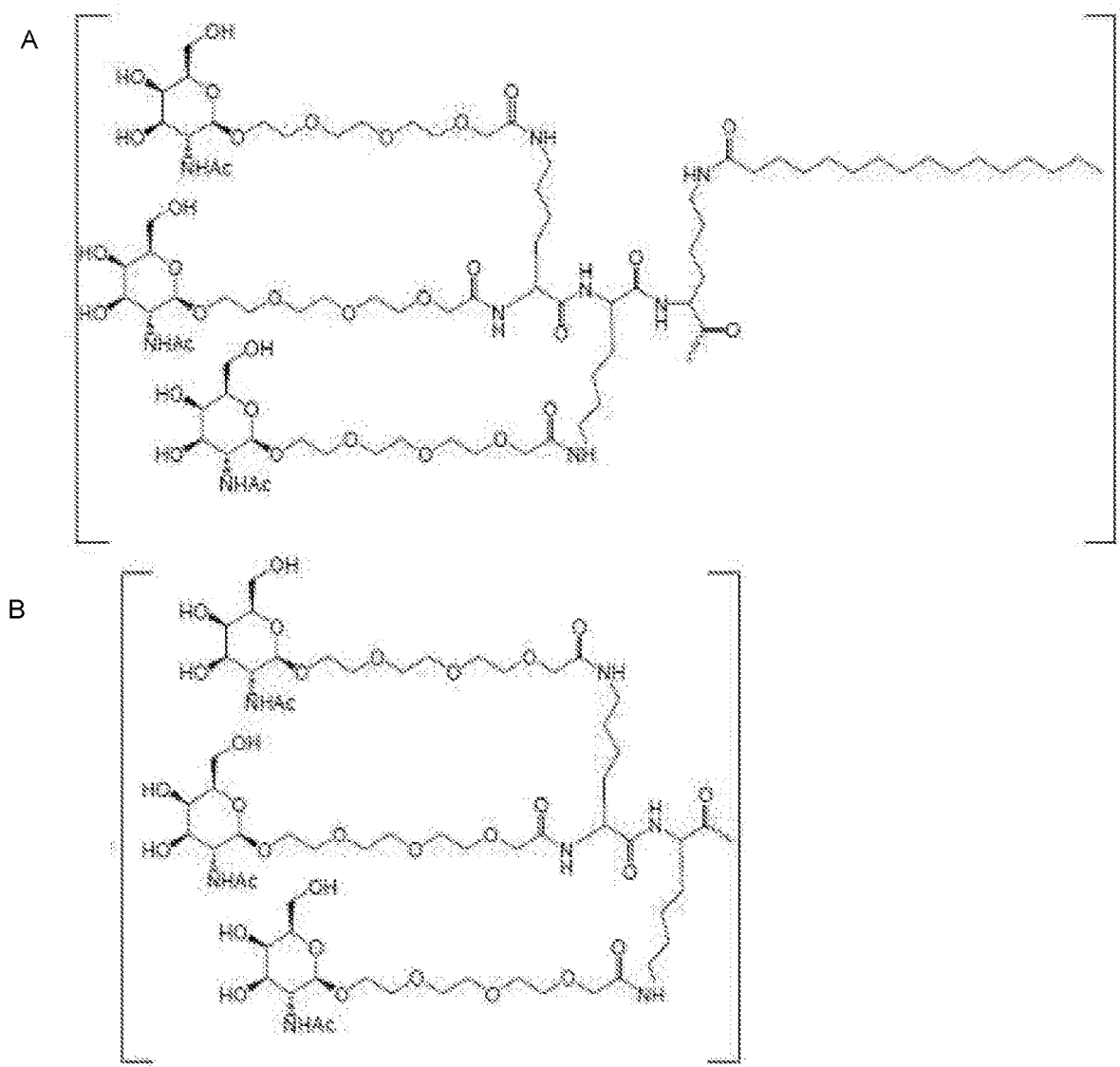
FIG. 1: Illustrates exemplary antisense oligonucleotide conjugates, where the oligonucleotide either is represented as a wavy line (A-D) or as "oligonucleotide" (E-H) or as $T_2$ (I) and the asialoglycoprotein receptor targeting conjugate moieties are trivalent N-acetylgalactosamine moieties. Compounds A to D comprise a di-lysine brancher molecule a PEG3 spacer and three terminal GalNAc carbohydrate moieties. In compound A and B the oligonucleotide is attached directly to the asialoglycoprotein receptor targeting conjugate moiety without a linker. In compound C and D the oligonucleotide is attached directly to the asialoglycoprotein receptor targeting conjugate moiety via a C6 linker. Compounds E-I comprise a trebler brancher molecule and spacers of varying length and structure and three terminal GalNAc carbohydrate moieties.
Figure 1:
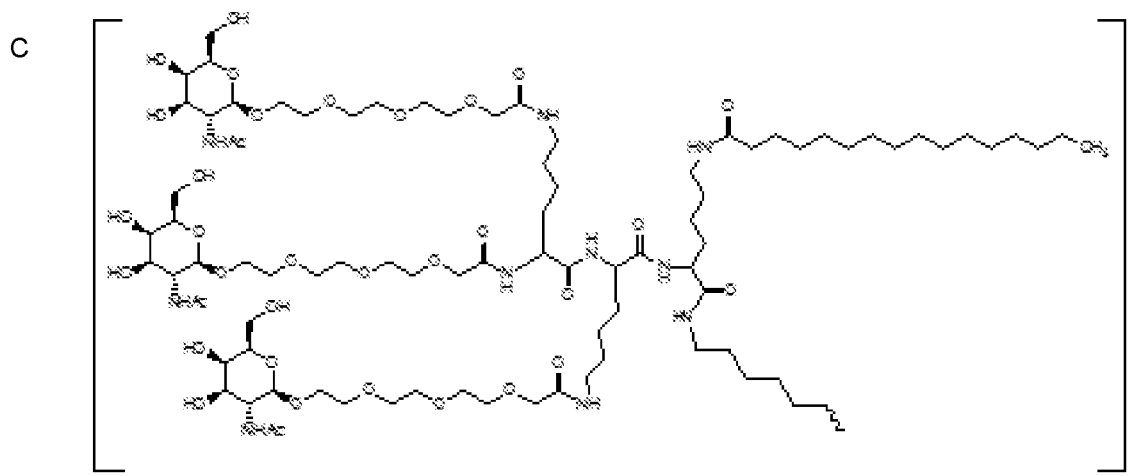
Figure 1:
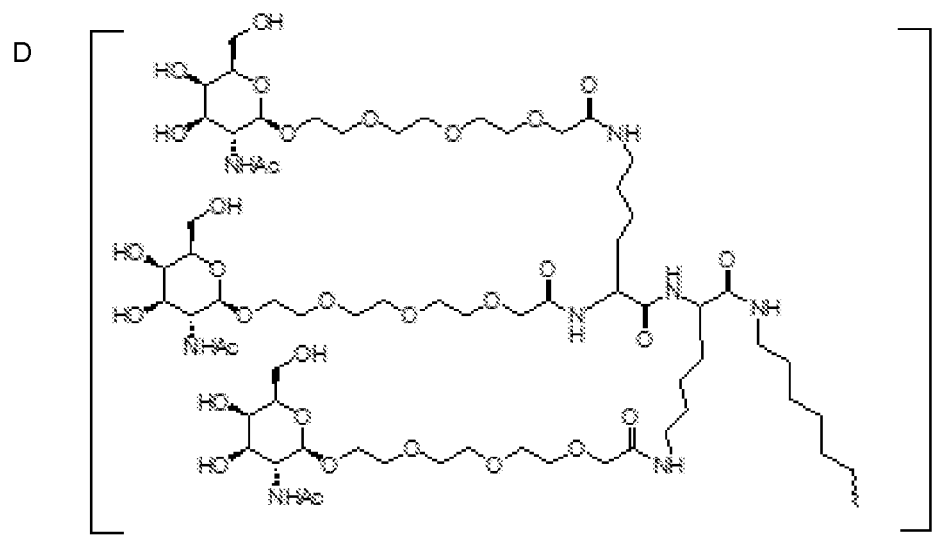
Figure 1:
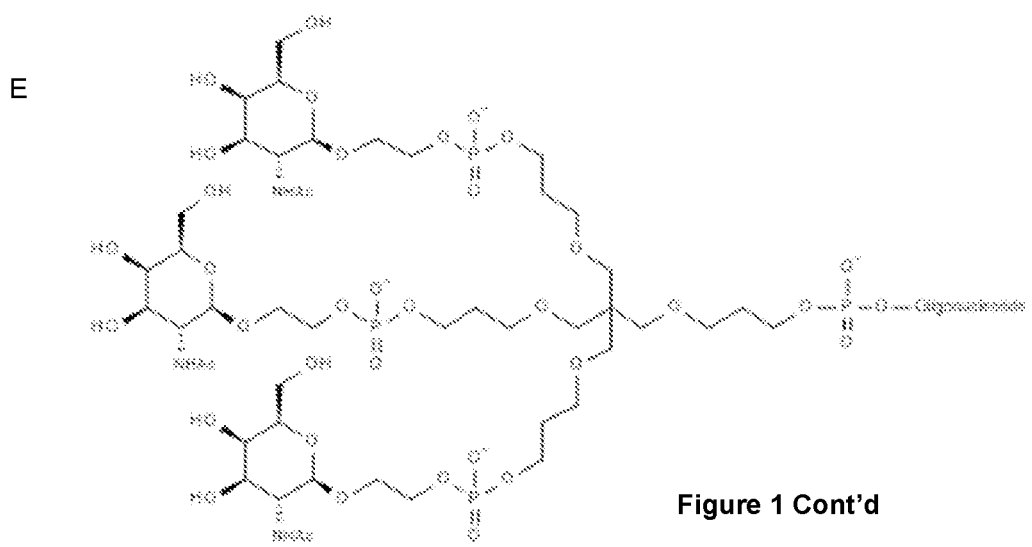
Figure 1:
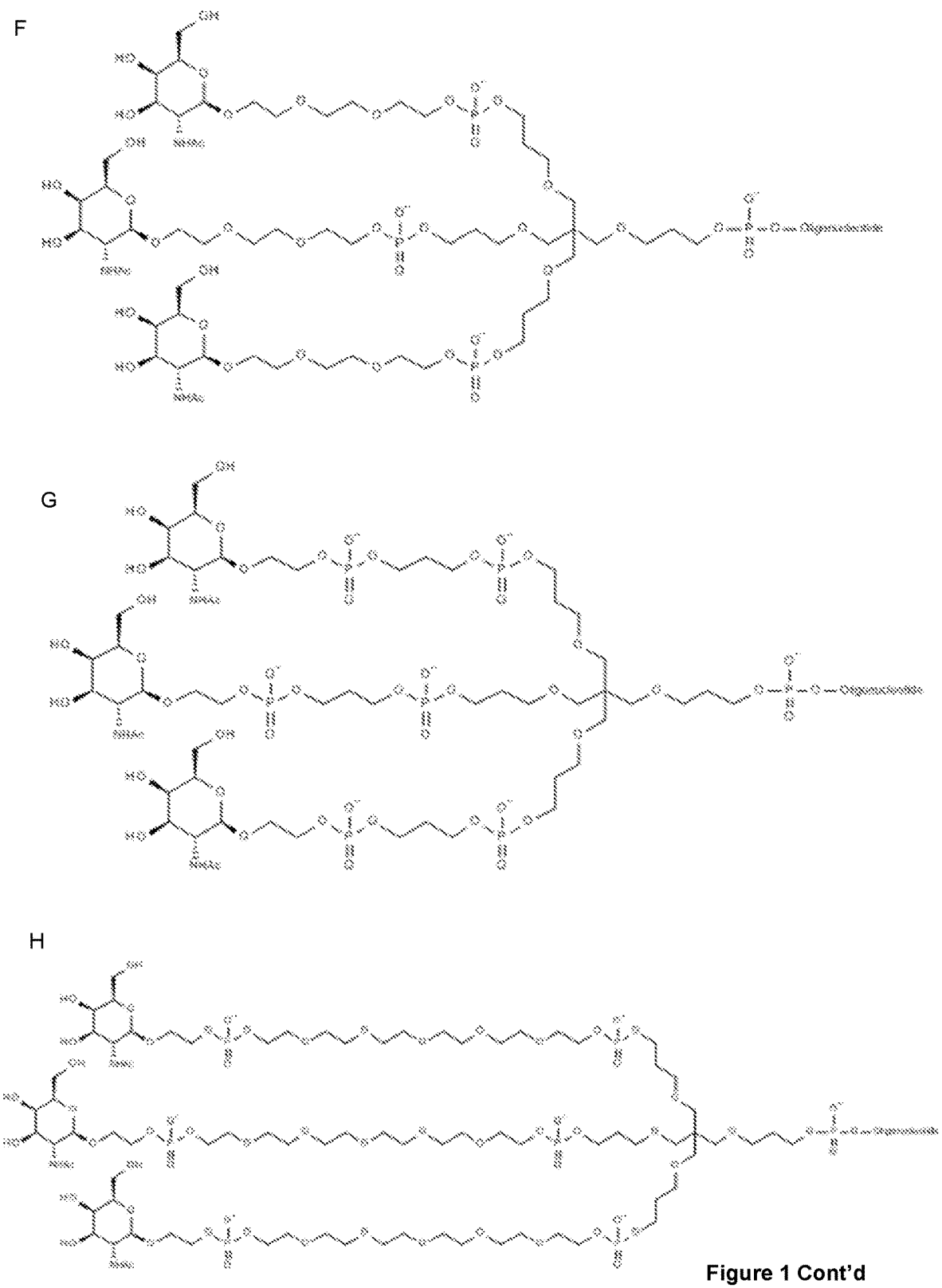
Figure 1:
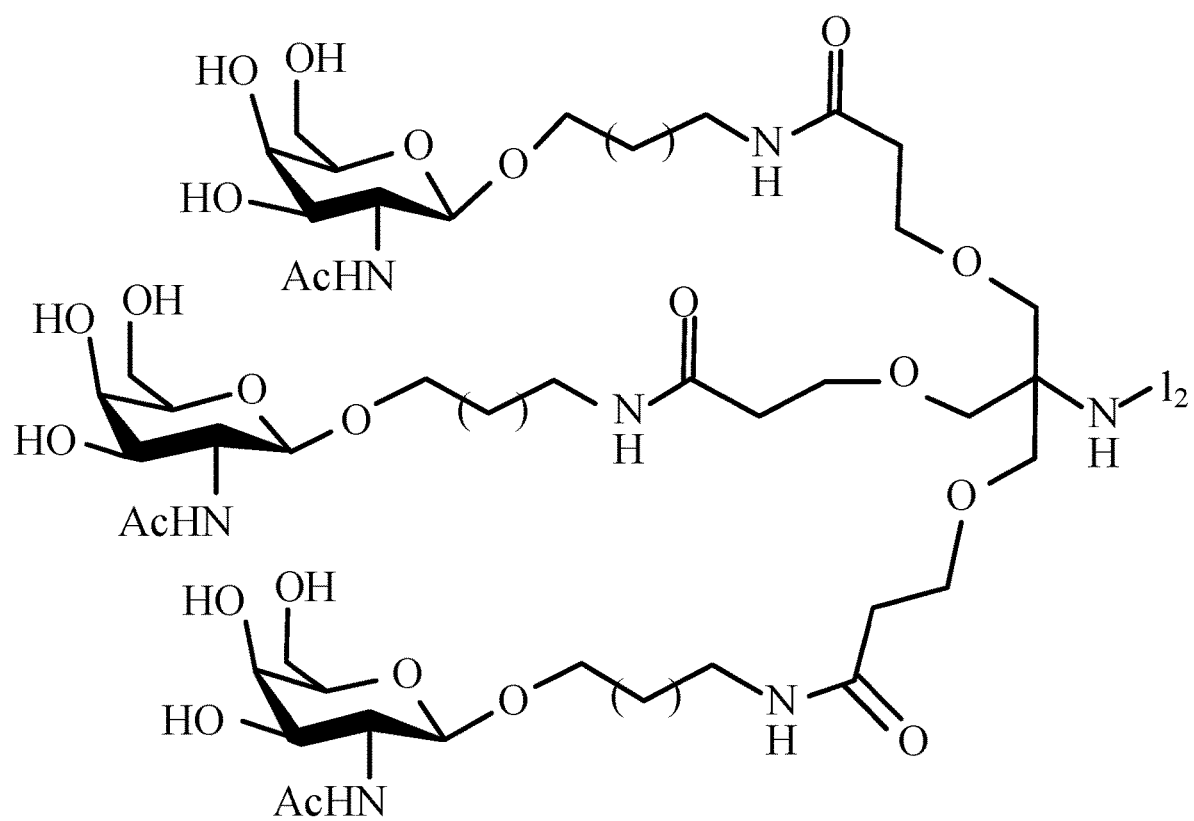

The term "oligonucleotide" as used herein is defined as it is generally understood by the skilled person as a molecule comprising two or more covalently linked nucleosides. Such covalently bound nucleosides may also be referred to as nucleic acid molecules or oligomers. Oligonucleotides are commonly made in the laboratory by solid-phase chemical synthesis followed by purification. When referring to a sequence of the oligonucleotide, reference is made to the sequence or order of nucleobase moieties, or modifications thereof, of the covalently linked nucleotides or nucleosides. The oligonucleotide of the invention is man-made, and is chemically synthesized, and is typically purified or isolated. The oligonucleotide of the invention may comprise one or more modified nucleosides or nucleotides.

Antisense Oligonucleotides

The term "Antisense oligonucleotide" as used herein is defined as oligonucleotides capable of modulating expression of a target gene by hybridizing to a target nucleic acid, in particular to a contiguous sequence on a target nucleic acid. The antisense oligonucleotides are not essentially double stranded and are therefore not siRNAs. Preferably, the antisense oligonucleotides of the present invention are single stranded.

Contiguous Nucleotide Sequence

The term "contiguous nucleotide sequence" refers to the region of the oligonucleotide which is complementary to the target nucleic acid. The term is used interchangeably herein with the term "contiguous nucleobase sequence" and the term "oligonucleotide motif sequence". In some embodiments all the nucleotides of the oligonucleotide constitute the contiguous nucleotide sequence. In some embodiments the oligonucleotide comprises the contiguous nucleotide sequence and may optionally comprise further nucleotide(s), for example a nucleotide linker region which may be used to attach a functional group to the contiguous nucleotide sequence. The nucleotide linker region may or may not be complementary to the target nucleic acid.

Nucleotides

Nucleotides are the building blocks of oligonucleotides and polynucleotides and for the purposes of the present invention include both naturally occurring and non-naturally occurring nucleotides. In nature, nucleotides, such as DNA and RNA nucleotides comprise a ribose sugar moiety, a nucleobase moiety and one or more phosphate groups (which is absent in nucleosides). Nucleosides and nucleotides may also interchangeably be referred to as "units" or "monomers".

Modified Nucleoside

The term "modified nucleoside" or "nucleoside modification" as used herein refers to nucleosides modified as compared to the equivalent DNA or RNA nucleoside by the introduction of one or more modifications of the sugar moiety or the (nucleo) base moiety. In a preferred embodiment the modified nucleoside comprise a modified sugar moiety. The term modified nucleoside may also be used herein interchangeably with the term "nucleoside analogue" or modified "units" or modified "monomers".

Modified Internucleoside Linkage

The term "modified internucleoside linkage" is defined as generally understood by the skilled person as linkages other than phosphodiester (PO) linkages, that covalently couples two nucleosides together. Nucleotides with modified internucleoside linkage are also termed "modified nucleotides". In some embodiments, the modified internucleoside linkage increases the nuclease resistance of the oligonucleotide compared to a phosphodiester linkage. For naturally occurring oligonucleotides, the internucleoside linkage includes phosphate groups creating a phosphodiester bond between adjacent nucleosides. Modified internucleoside linkages are particularly useful in stabilizing oligonucleotides for in vivo use, and may serve to protect against nuclease cleavage at regions of DNA or RNA nucleosides in the oligonucleotide of the invention, for example within the gap region of a gapmer oligonucleotide, as well as in regions of modified nucleosides.

In an embodiment, the oligonucleotide comprises one or more internucleoside linkages modified from the natural phosphodiester to a linkage that is for example more resistant to nuclease attack. Nuclease resistance may be determined by incubating the oligonucleotide in blood serum or by using a nuclease resistance assay (e.g. snake venom phosphodiesterase (SVPD)), both are well known in the art. Internucleoside linkages which are capable of enhancing the nuclease resistance of an oligonucleotide are referred to as nuclease resistant internucleoside linkages. In some embodiments at least 50% of the internucleoside linkages in the oligonucleotide, or contiguous nucleotide sequence thereof, are modified, such as at least 60%, such as at least 70%, such as at least 80 or such as at least 90% of the internucleoside linkages in the oligonucleotide, or contiguous nucleotide sequence thereof, are modified. In some embodiments all of the internucleoside linkages of the oligonucleotide, or contiguous nucleotide sequence thereof, are modified. It will be recognized that, in some embodiments the nucleosides which link the oligonucleotide of the invention to a non-nucleotide functional group, such as a conjugate, may be phosphodiester. In some embodiments all of the internucleoside linkages of the oligonucleotide, or contiguous nucleotide sequence thereof, are nuclease resistant internucleoside linkages.

Modified internucleoside linkages may be selected from the group comprising phosphorothioate, diphosphorothioate and boranophosphate. In some embodiments, the modified internucleoside linkages are compatible with the RNaseH recruitment of the oligonucleotide of the invention, for example phosphorothioate, diphosphorothioate or boranophosphate.

In some embodiments the internucleoside linkage comprises sulphur(S), such as a phosphorothioate internucleoside linkage.

A phosphorothioate internucleoside linkage is particularly useful due to nuclease resistance, beneficial pharmacokinetics and ease of manufacture. In some embodiments at least 50% of the internucleoside linkages in the oligonucleotide, or contiguous nucleotide sequence thereof, are phosphorothioate, such as at least 60%, such as at least 70%, such as at least 80 or such as at least 90% of the internucleoside linkages in the oligonucleotide, or contiguous nucleotide sequence thereof, are phosphorothioate. In some embodiments all of the internucleoside linkages of the oligonucleotide, or contiguous nucleotide sequence thereof, are phosphorothioate.

In some embodiments, the oligonucleotide comprises one or more neutral internucleoside linkage, particularly a internucleoside linkage selected from phosphotriester, methylphosphonate, MMI, amide-3, formacetal or thioformacetal.

Further internucleoside linkages are disclosed in WO2009/124238 (incorporated herein by reference). In an embodiment the internucleoside linkage is selected from linkers disclosed in WO2007/031091 (incorporated herein by reference). Particularly, the internucleoside linkage may be selected from —O—P(O)$_2$—O—, —O—P(O,S)—O—, —O—P(S)$_2$—O—, —S—P(O)$_2$—O—, —S—P(O,S)—O—, —S—P(S)$_2$—O—, —O—P(O)$_2$—S—, —O—P(O,S)—S—, —S—P(O)$_2$—S—, —O—PO(R$^H$)—O—, O—PO(OCH$_3$)—O—, —O—PO(NR$^H$)—O—, —O—PO(OCH$_2$CH$_2$S—R)—O—, —O—PO(BH$_3$)—O—, —O—PO(NHR$^H$)—O—, —O—P(O)$_2$—NR$^H$—, —NR$^H$—P(O)$_2$—O—, —NR$^H$—CO—O—, —NR$^H$—CO—NR$^H$—, and/or the internucleoside linker may be selected form the group consisting of: —O—CO—O, —O—CO—NR$^H$—, —NR$^H$—CO—CH$_2$—, —O—CH$_2$—CO—NR$^H$—, —O—CH$_2$—CH$_2$—NR$^H$—, —CO—NR$^H$—CH$_2$—, —CH$_2$—NR$^H$CO—, —O—CH$_2$—CH$_2$—S—, —S—CH$_2$—CH$_2$—O—, —S—CH$_2$—CH$_2$—S—, —CH$_2$—SO$_2$—CH$_2$—, —CH$_2$—CO—NR$^H$—, —O—CH$_2$—CH$_2$—NR$^H$—CO—, —CH$_2$—NCH$_3$—O—CH$_2$—, where R$^H$ is selected from hydrogen and C1-4-alkyl.

Nuclease resistant linkages, such as phosphothioate linkages, are particularly useful in oligonucleotide regions capable of recruiting nuclease when forming a duplex with the target nucleic acid, such as region G for gapmers, or the non-modified nucleoside region of headmers and tailmers. Phosphorothioate linkages may, however, also be useful in non-nuclease recruiting regions and/or affinity enhancing regions such as regions F and F' for gapmers, or the modified nucleoside region of headmers and tailmers.

Each of the design regions may however comprise internucleoside linkages other than phosphorothioate, such as phosphodiester linkages, in particular in regions where modified nucleosides, such as LNA, protect the linkage against nuclease degradation. Inclusion of phosphodiester linkages, such as one or two linkages, particularly between or adjacent to modified nucleoside units (typically in the non-nuclease recruiting regions) can modify the bioavailability and/or bio-distribution of an oligonucleotide—see WO2008/113832, incorporated herein by reference.

In an embodiment all the internucleoside linkages in the oligonucleotide are phosphorothioate and/or boranophosphate linkages. Preferably, all the internucleoside linkages in the oligonucleotide are phosphorothioate linkages.

Nucleobase

The term nucleobase includes the purine (e.g. adenine and guanine) and pyrimidine (e.g. uracil, thymine and cytosine) moiety present in nucleosides and nucleotides which form hydrogen bonds in nucleic acid hybridization. In the context of the present invention the term nucleobase also encompasses modified nucleobases which may differ from naturally occurring nucleobases, but are functional during nucleic acid hybridization. In this context "nucleobase" refers to both naturally occurring nucleobases such as adenine, guanine, cytosine, thymidine, uracil, xanthine and hypoxanthine, as well as non-naturally occurring variants. Such variants are for example described in Hirao et al (2012) Accounts of Chemical Research vol 45 page 2055 and Bergstrom (2009) Current Protocols in Nucleic Acid Chemistry Suppl. 37 1.4.1.

In a some embodiments the nucleobase moiety is modified by changing the purine or pyrimidine into a modified purine or pyrimidine, such as substituted purine or substituted pyrimidine, such as a nucleobased selected from isocytosine, pseudoisocytosine, 5-methyl cytosine, 5-thiozolo-cytosine, 5-propynyl-cytosine, 5-propynyl-uracil, 5-bromouracil 5-thiazolo-uracil, 2-thio-uracil, 2'thio-thymine, inosine, diaminopurine, 6-aminopurine, 2-aminopurine, 2,6-diaminopurine and 2-chloro-6-aminopurine.

The nucleobase moieties may be indicated by the letter code for each corresponding nucleobase, e.g. A, T, G, C or U, wherein each letter may optionally include modified nucleobases of equivalent function. For example, in the exemplified oligonucleotides, the nucleobase moieties are selected from A, T, G, C, and 5-methyl cytosine. Optionally, for LNA gapmers, 5-methyl cytosine LNA nucleosides may be used.

Modified Oligonucleotide

The term modified oligonucleotide describes an oligonucleotide comprising one or more sugar-modified nucleosides and/or modified internucleoside linkages. The term chimeric" oligonucleotide is a term that has been used in the literature to describe oligonucleotides with modified nucleosides.

Complementarity

The term "complementarity" describes the capacity for Watson-Crick base-pairing of nucleosides/nucleotides. Watson-Crick base pairs are guanine (G)-cytosine (C) and adenine (A)-thymine (T)/uracil (U). It will be understood that oligonucleotides may comprise nucleosides with modified nucleobases, for example 5-methyl cytosine is often used in place of cytosine, and as such the term complementarity encompasses Watson Crick base-paring between non-modified and modified nucleobases (see for example Hirao et al (2012) Accounts of Chemical Research vol 45 page 2055 and Bergstrom (2009) Current Protocols in Nucleic Acid Chemistry Suppl. 37 1.4.1).

The term "% complementary" as used herein, refers to the number of nucleotides in percent of a contiguous nucleotide sequence in a nucleic acid molecule (e.g. oligonucleotide) which, at a given position, are complementary to (i.e. form Watson Crick base pairs with) a contiguous nucleotide sequence, at a given position of a separate nucleic acid molecule (e.g. the target nucleic acid). The percentage is calculated by counting the number of aligned bases that form pairs between the two sequences (when aligned with the target sequence 5'-3' and the oligonucleotide sequence from 3'-5'), dividing by the total number of nucleotides in the oligonucleotide and multiplying by 100. In such a comparison a nucleobase/nucleotide which does not align (form a base pair) is termed a mismatch.

The term "fully complementary", refers to 100% complementarity.

The following is an example of an oligonucleotide (SEQ ID NO: 5) that is fully complementary to the target nucleic acid (SEQ ID NO: 772).

```
                                        (SEQ ID NO: 772)
                        5'gcagtagagccaatta3'

(SEQ ID NO: 5)
                        3'cgtcatctcggttaat5'
```

Identity

The term "Identity" as used herein, refers to the number of nucleotides in percent of a contiguous nucleotide sequence in a nucleic acid molecule (e.g. oligonucleotide) which, at a given position, are identical to (i.e. in their ability to form Watson Crick base pairs with the complementary nucleoside) a contiguous nucleotide sequence, at a given position of a separate nucleic acid molecule (e.g. the target nucleic acid). The percentage is calculated by counting the number of aligned bases that are identical between the two sequences, including gaps, dividing by the total number of nucleotides in the oligonucleotide and multiplying by 100. Percent Identity=(Matches×100)/Length of aligned region (with gaps).

Hybridization

The term "hybridizing" or "hybridizes" as used herein is to be understood as two nucleic acid strands (e.g. an oligonucleotide and a target nucleic acid) forming hydrogen bonds between base pairs on opposite strands thereby forming a duplex. The affinity of the binding between two nucleic acid strands is the strength of the hybridization. It is often described in terms of the melting temperature ($T_m$) defined as the temperature at which half of the oligonucleotides are duplexed with the target nucleic acid. At physiological conditions $T_m$ is not strictly proportional to the affinity (Mergny and Lacroix, 2003, *Oligonucleotides* 13:515-537). The standard state Gibbs free energy $\Delta G°$ is a more accurate representation of binding affinity and is related to the dissociation constant ($K_d$) of the reaction by $\Delta G°=-RTln(K_d)$, where R is the gas constant and T is the absolute temperature. Therefore, a very low $\Delta G°$ of the reaction between an oligonucleotide and the target nucleic acid reflects a strong hybridization between the oligonucleotide and target nucleic acid. $\Delta G°$ is the energy associated with a reaction where aqueous concentrations are 1M, the pH is 7, and the temperature is 37° C. The hybridization of oligonucleotides to a target nucleic acid is a spontaneous reaction and for spontaneous reactions $\Delta G°$ is less than zero. $\Delta G°$ can be measured experimentally, for example, by use of the isothermal titration calorimetry (ITC) method as described in Hansen et al., 1965, *Chem. Comm.* 36-38 and Holdgate et al., 2005, *Drug Discov Today. The skilled person will know that commercial equipment is available for $\Delta G°$ measurements. $\Delta G°$ can also be estimated numerically by using the nearest neighbor model as described by SantaLucia, 1998, Proc Natl Acad Sci USA.* 95:1460-1465 using appropriately derived thermodynamic parameters described by Sugimoto et al., 1995, *Biochemistry* 34:11211-11216 and McTigue et al., 2004, *Biochemistry* 43:5388-5405. In order to have the possibility of modulating its intended nucleic acid target by hybridization, oligonucleotides of the present invention hybridize to a target nucleic acid with estimated $\Delta G°$ values below −10 kcal for oligonucleotides that are 10-30 nucleotides in length. In some embodiments the degree or strength of hybridization is measured by the standard state Gibbs free energy $\Delta G°$. The oligonucleotides may hybridize to a target nucleic acid with estimated $\Delta G°$ values below the range of −10 kcal, such as below −15 kcal, such as below −20 kcal and such as below −25 kcal for oligonucleotides that are 8-30 nucleotides in length. In some embodiments the oligonucleotides hybridize to a target nucleic acid with an estimated $\Delta G°$ value of −10 to −60 kcal, such as −12 to −40, such as from −15 to −30 kcal or −16 to −27 kcal such as −18 to −25 kcal.

Target Nucleic Acid

According to the present invention, the target nucleic acid is a nucleic acid which encodes mammalian PD-L1 and may for example be a gene, a RNA, a mRNA, and pre-mRNA, a mature mRNA or a cDNA sequence. The target may therefore be referred to as a PD-L1 target nucleic acid. The oligonucleotide of the invention may for example target exon regions of a mammalian PD-L1, or may for example target intron region in the PD-L1 pre-mRNA (see Table 1).

TABLE 1 human PD-L1 Exons and Introns

| Exonic regions in the human PD-L1 premRNA (SEQ ID NO 1) | | | Intronic regions in the human PD-L1 premRNA (SEQ ID NO 1) | | |
|---|---|---|---|---|---|
| ID | start | end | ID | start | end |
| e1 | 1 | 94 | i1 | 95 | 5597 |
| e2 | 5598 | 5663 | i2 | 5664 | 6576 |
| e3 | 6577 | 6918 | i3 | 6919 | 12331 |
| e4 | 12332 | 12736 | i4 | 12737 | 14996 |
| e5 | 14997 | 15410 | i5 | 15411 | 16267 |
| e6 | 16268 | 16327 | i6 | 16328 | 17337 |
| e7 | 17338 | 20064 | | | |

Suitably, the target nucleic acid encodes a PD-L1 protein, in particular mammalian PD-L1, such as human PD-L1 (See for example tables 2 and 3, which provide reference to the mRNA and pre-mRNA sequences for human, monkey, and mouse PD-L1). In the context of the present invention pre-mRNA is also considered as a nucleic acid that encodes a protein.

In some embodiments, the target nucleic acid is selected from the group consisting of SEQ ID NO: 1, 2 and 3 or naturally occurring variants thereof (e.g. sequences encoding a mammalian PD-L1 protein).

If employing the oligonucleotide of the invention in research or diagnostics the target nucleic acid may be a cDNA or a synthetic nucleic acid derived from DNA or RNA.

For in vivo or in vitro application, the oligonucleotide of the invention is typically capable of inhibiting the expression of the PD-L1 target nucleic acid in a cell which is expressing the PD-L1 target nucleic acid. The contiguous sequence of nucleobases of the oligonucleotide of the invention is typically complementary to the PD-L1 target nucleic acid, as measured across the length of the oligonucleotide, optionally with the exception of one or two mismatches, and optionally excluding nucleotide based linker regions which may link the oligonucleotide to an optional functional group such as a conjugate, or other non-complementary terminal nucleotides (e.g. region D' or D"). The target nucleic acid may, in some embodiments, be a RNA or DNA, such as a messenger RNA, such as a mature mRNA or a pre-mRNA. In some embodiments the target nucleic acid is a RNA or DNA which encodes mammalian PD-L1 protein, such as human PD-L1, e.g. the human PD-L1 premRNA sequence, such as that disclosed as SEQ ID NO 1 or the human mRNA sequence with NCBI reference number NM_014143. Further information on exemplary target nucleic acids is provided in tables 2 and 3.

TABLE 2

Genome and assembly information for PD-L1 across species.

| Species | Chr. | Strand | Genomic coordinates Start | End | Assembly | NCBI reference sequence* accession number for mRNA |
|---|---|---|---|---|---|---|
| Human | 9 | fwd | 5450503 | 5470566 | GRCh38: CM000671.2 | NM_014143 |
| Cynomolgus monkey | 15 | | 73560846 | 73581371 | GCF_000364345.1 | XM_005581779 |
| Mouse | 19 | fwd | 29367455 | 29388095 | GRCm38: CM001012.2 | NM_021893 |

Fwd = forward strand. The genome coordinates provide the pre-mRNA sequence (genomic sequence).
The NCBI reference provides the mRNA sequence (cDNA sequence).
*The National Center for Biotechnology Information reference sequence database is a comprehensive, integrated, non-redundant, well-annotated set of reference sequences including genomic, transcript, and protein. It is hosted at www.ncbi.nlm-.nih.gov/refseq.

TABLE 3

Sequence details for PD-L1 across species.

| Species | RNA type | Length (nt) | SEQ ID NO |
|---|---|---|---|
| Human | premRNA | 20064 | 1 |
| Monkey Cyno | premRNA GCF ref | 20261 | 2 |
| Monkey Cyno | premRNA Internal | 20340 | 3 |
| Mouse | premRNA | 20641 | 4 |

Target Sequence

The term "target sequence" as used herein refers to a sequence of nucleotides present in the target nucleic acid which comprises the nucleobase sequence which is complementary to the oligonucleotide of the invention. In some embodiments, the target sequence consists of a region on the target nucleic acid which is complementary to the contiguous nucleotide sequence of the oligonucleotide of the invention. In some embodiments the target sequence is longer than the complementary sequence of a single oligonucleotide, and may, for example represent a preferred region of the target nucleic acid which may be targeted by several oligonucleotides of the invention.

The target sequence may be a sub-sequence of the target nucleic acid.

In some embodiments the sub-sequence is a sequence selected from the group consisting of a1-a149 (see tables 4). In some embodiments the sub-sequence is a sequence selected from the group consisting of a human PD-L1 mRNA exon, such as a PD-L1 human mRNA exon selected from the group consisting of e1, e2, e3, e4, e5, e6, and e7 (see table 1 above).

In some embodiments the sub-sequence is a sequence selected from the group consisting of a human PD-L1 mRNA intron, such as a PD-L1 human mRNA intron selected from the group consisting of i1, i2, i3, 14, 15 and i6 (see table 1 above).

The oligonucleotide of the invention comprises a contiguous nucleotide sequence which is complementary to or hybridizes to the target nucleic acid, such as a sub-sequence of the target nucleic acid, such as a target sequence described herein.

The oligonucleotide comprises a contiguous nucleotide sequence of at least 8 nucleotides which is complementary to or hybridizes to a target sequence present in the target nucleic acid molecule. The contiguous nucleotide sequence (and therefore the target sequence) comprises of at least 8 contiguous nucleotides, such as 9, 10, 11, 12, 13, 14, 15, 16, 17, 18, 19, 20, 21, 22, 23, 24, 25, 26, 27, 28, 29 or 30 contiguous nucleotides, such as from 12-25, such as from 14-18 contiguous nucleotides.

Target Cell

The term a "target cell" as used herein refers to a cell which is expressing the target nucleic acid. In some embodiments the target cell may be in vivo or in vitro. In some embodiments the target cell is a mammalian cell such as a rodent cell, such as a mouse cell or a rat cell, or a primate cell such as a monkey cell or a human cell.

In preferred embodiments the target cell expresses PD-L1 mRNA, such as the PD-L1 pre-mRNA or PD-L1 mature mRNA. The poly A tail of PD-L1 mRNA is typically disregarded for antisense oligonucleotide targeting.

Naturally Occurring Variant

The term "naturally occurring variant" refers to variants of PD-L1 gene or transcripts which originate from the same genetic loci as the target nucleic acid, but may differ for example, by virtue of degeneracy of the genetic code causing a multiplicity of codons encoding the same amino acid, or due to alternative splicing of pre-mRNA, or the presence of polymorphisms, such as single nucleotide polymorphisms, and allelic variants. Based on the presence of the sufficient complementary sequence to the oligonucleotide, the oligonucleotide of the invention may therefore target the target nucleic acid and naturally occurring variants thereof.

In some embodiments, the naturally occurring variants have at least 95% such as at least 98% or at least 99% homology to a mammalian PD-L1 target nucleic acid, such as a target nucleic acid selected form the group consisting of SEQ ID NO 1, 2 and 3.

Numerous single nucleotide polymorphisms are known in the PD-L1 gene, for example those disclosed in the following table (human premRNA start/reference sequence is SEQ ID NO 2)

| Variant name | Variant alleles | minor allele | Minor allele frequency | Start on SEQ ID NO: 1 |
|---|---|---|---|---|
| rs73397192 | G/A | A | 0.10 | 2591 |
| rs12342381 | A/G | G | 0.12 | 308 |
| rs16923173 | G/A | A | 0.13 | 14760 |
| rs2890658 | C/A | A | 0.16 | 14628 |
| rs2890657 | G/C | C | 0.21 | 2058 |
| rs3780395 | A/G | A | 0.21 | 14050 |
| rs147367592 | AG/— | — | 0.21 | 13425 |
| rs7023227 | T/C | T | 0.22 | 6048 |
| rs2297137 | G/A | A | 0.23 | 15230 |
| rs1329946 | G/A | A | 0.23 | 2910 |
| rs5896124 | —/G | G | 0.23 | 2420 |
| rs61061063 | T/C | C | 0.23 | 11709 |
| rs1411263 | T/C | C | 0.23 | 8601 |
| rs59906468 | A/G | G | 0.23 | 15583 |

-continued

| Variant name | Variant alleles | minor allele | Minor allele frequency | Start on SEQ ID NO: 1 |
|---|---|---|---|---|
| rs6476976 | T/C | T | 0.24 | 21012 |
| rs35744625 | C/A | A | 0.24 | 3557 |
| rs17804441 | T/C | C | 0.24 | 7231 |
| rs148602745 | C/T | T | 0.25 | 22548 |
| rs4742099 | G/A | A | 0.25 | 20311 |
| rs10815228 | T/C | C | 0.25 | 21877 |
| rs58817806 | A/G | G | 0.26 | 20769 |
| rs822342 | T/C | T | 0.27 | 3471 |
| rs10481593 | G/A | A | 0.27 | 7593 |
| rs822339 | A/G | A | 0.28 | 2670 |
| rs860290 | A/C | A | 0.28 | 2696 |
| rs822340 | A/G | A | 0.28 | 2758 |
| rs822341 | T/C | T | 0.28 | 2894 |
| rs12002985 | C/G | C | 0.28 | 6085 |
| rs822338 | C/T | C | 0.28 | 1055 |
| rs866066 | C/T | T | 0.28 | 451 |
| rs6651524 | A/T | T | 0.28 | 8073 |
| rs6415794 | A/T | A | 0.28 | 8200 |
| rs4143815 | G/C | C | 0.28 | 17755 |
| rs111423622 | G/A | A | 0.28 | 24096 |
| rs6651525 | C/A | A | 0.29 | 8345 |
| rs4742098 | A/G | G | 0.29 | 19995 |
| rs10975123 | C/T | T | 0.30 | 10877 |
| rs2282055 | T/G | G | 0.30 | 5230 |
| rs4742100 | A/C | C | 0.30 | 20452 |
| rs60520638 | —/TC | TC | 0.30 | 9502 |
| rs17742278 | T/C | C | 0.30 | 6021 |
| rs7048841 | T/C | T | 0.30 | 10299 |
| rs10815229 | T/G | G | 0.31 | 22143 |
| rs10122089 | C/T | C | 0.32 | 13278 |
| rs1970000 | C/A | C | 0.32 | 14534 |
| rs112071324 | AGAGAG/— | AGAGAG | 0.33 | 16701 |
| rs2297136 | G/A | G | 0.33 | 17453 |
| rs10815226 | A/T | T | 0.33 | 9203 |
| rs10123377 | A/G | A | 0.36 | 10892 |
| rs10123444 | A/G | A | 0.36 | 11139 |
| rs7042084 | G/T | G | 0.36 | 7533 |
| rs10114060 | G/A | A | 0.36 | 11227 |
| rs7028894 | G/A | G | 0.36 | 10408 |
| rs4742097 | C/T | C | 0.37 | 5130 |
| rs1536926 | G/T | G | 0.37 | 13486 |
| rs1411262 | C/T | T | 0.39 | 8917 |
| rs7041009 | G/A | A | 0.45 | 12741 |

Modulation of Expression

The term "modulation of expression" as used herein is to be understood as an overall term for an oligonucleotide's ability to alter the amount of PD-L1 when compared to the amount of PD-L1 before administration of the oligonucleotide. Alternatively modulation of expression may be determined by reference to a control experiment. It is generally understood that the control is an individual or target cell treated with a saline composition or an individual or target cell treated with a non-targeting oligonucleotide (mock). It may however also be an individual treated with the standard of care.

One type of modulation is an oligonucleotide's ability to inhibit, down-regulate, reduce, suppress, remove, stop, block, prevent, lessen, lower, avoid or terminate expression of PD-L1, e.g. by degradation of mRNA or blockage of transcription. Another type of modulation is an oligonucleotide's ability to restore, increase or enhance expression of PD-L1, e.g. by repair of splice sites or prevention of splicing or removal or blockage of inhibitory mechanisms such as microRNA repression.

High Affinity Modified Nucleosides

A high affinity modified nucleoside is a modified nucleotide which, when incorporated into the oligonucleotide enhances the affinity of the oligonucleotide for its complementary target, for example as measured by the melting temperature ($T^m$). A high affinity modified nucleoside of the present invention preferably result in an increase in melting temperature between +0.5 to +12° C., more preferably between +1.5 to +10° C. and most preferably between +3 to +8° C. per modified nucleoside. Numerous high affinity modified nucleosides are known in the art and include for example, many 2' substituted nucleosides as well as locked nucleic acids (LNA) (see e.g. Freier & Altmann; Nucl. Acid Res., 1997, 25, 4429-4443 and Uhlmann; Curr. Opinion in Drug Development, 2000, 3 (2), 293-213).

Sugar Modifications

The oligomer of the invention may comprise one or more nucleosides which have a modified sugar moiety, i.e. a modification of the sugar moiety when compared to the ribose sugar moiety found in DNA and RNA.

Numerous nucleosides with modification of the ribose sugar moiety have been made, primarily with the aim of improving certain properties of oligonucleotides, such as affinity and/or nuclease resistance.

Such modifications include those where the ribose ring structure is modified, e.g. by replacement with a hexose ring (HNA), or a bicyclic ring, which typically have a biradicle bridge between the C2 and C4 carbons on the ribose ring (LNA), or an unlinked ribose ring which typically lacks a bond between the C2 and C3 carbons (e.g. UNA). Other sugar modified nucleosides include, for example, bicyclohexose nucleic acids (WO2011/017521) or tricyclic nucleic acids (WO2013/154798). Modified nucleosides also include nucleosides where the sugar moiety is replaced with a non-sugar moiety, for example in the case of peptide nucleic acids (PNA), or morpholino nucleic acids.

Sugar modifications also include modifications made via altering the substituent groups on the ribose ring to groups other than hydrogen, or the 2'-OH group naturally found in DNA and RNA nucleosides. Substituents may, for example be introduced at the 2', 3', 4' or 5' positions. Nucleosides with modified sugar moieties also include 2' modified nucleosides, such as 2' substituted nucleosides. Indeed, much focus has been spent on developing 2' substituted nucleosides, and numerous 2' substituted nucleosides have been found to have beneficial properties when incorporated into oligonucleotides, such as enhanced nucleoside resistance and enhanced affinity.

2' Modified Nucleosides.

A 2' sugar modified nucleoside is a nucleoside which has a substituent other than H or —OH at the 2' position (2' substituted nucleoside) or comprises a 2' linked biradicle, and includes 2' substituted nucleosides and LNA (2'-4' biradicle bridged) nucleosides. For example, the 2' modified sugar may provide enhanced binding affinity and/or increased nuclease resistance to the oligonucleotide. Examples of 2' substituted modified nucleosides are 2'-O-alkyl-RNA, 2'-O-methyl-RNA, 2'-alkoxy-RNA, 2'-O-methoxyethyl-RNA (MOE), 2'-amino-DNA, 2'-Fluoro-RNA, and 2'-F-ANA nucleoside. For further examples, please see e.g. Freier & Altmann; Nucl. Acid Res., 1997, 25, 4429-4443 and Uhlmann; Curr. Opinion in Drug Development, 2000, 3 (2), 293-213, and Deleavey and Damha, Chemistry and Biology 2012, 19, 937. Below are illustrations of some 2' substituted modified nucleosides.

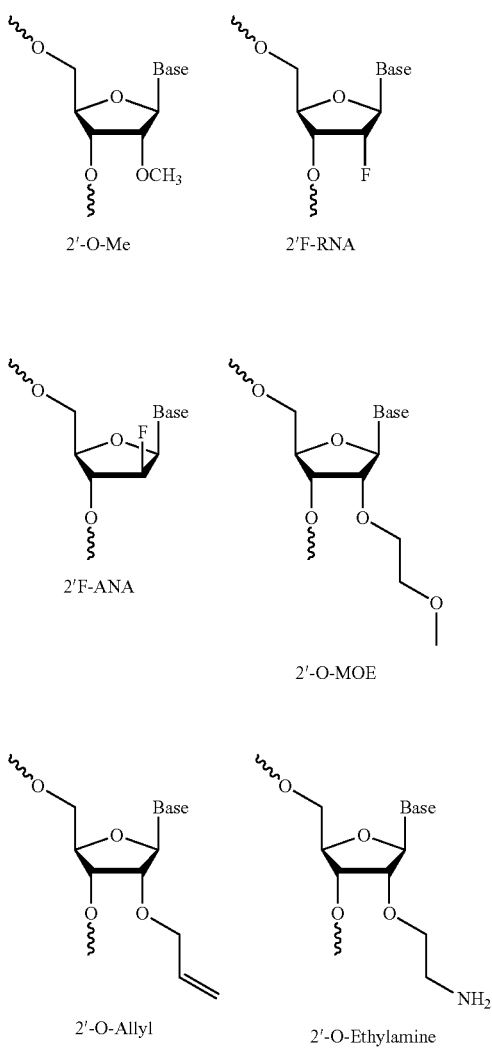

2'-O-Me

2'F-RNA

2'F-ANA

2'-O-MOE

2'-O-Allyl

2'-O-Ethylamine

Locked Nucleic Acid Nucleosides (LNA).

LNA nucleosides are modified nucleosides which comprise a linker group (referred to as a biradicle or a bridge) between C2' and C4' of the ribose sugar ring of a nucleotide. These nucleosides are also termed bridged nucleic acid or bicyclic nucleic acid (BNA) in the literature.

In some embodiments, the modified nucleoside or the LNA nucleosides of the oligomer of the invention has a general structure of the formula I or II:

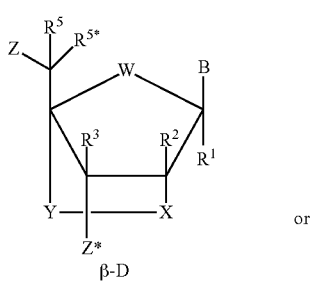

Formula I

β-D

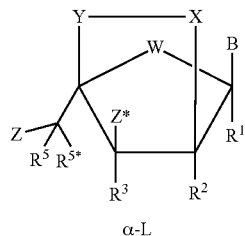

Formula II

α-L wherein W is selected from —O—, —S—, —N($R^a$)—, —C($R^a R^b$)—, such as, in some embodiments -O—; B designates a nucleobase or modified nucleobase moiety;

Z designates an internucleoside linkage to an adjacent nucleoside, or a 5'-terminal group;

Z* designates an internucleoside linkage to an adjacent nucleoside, or a 3'-terminal group;

X designates a group selected from the list consisting of —C($R^a R^b$)—, —C($R^a$)=C($R^b$)—, —C($R^a$)=N—, —O—, —Si($R^a$)$_2$—, —S—, —SO$_2$—, —N($R^a$)—, and >C=Z In some embodiments, X is selected from the group consisting of: —O—, —S—, NH—, NRa$R^b$, —CH$_2$—, CRa$R^b$, —C(=CH$_2$)—, and —C(=CRa$R^b$)—

In some embodiments, X is —O—

Y designates a group selected from the group consisting of —C($R^a R^b$)—, —C($R^a$)=C($R^b$)—, —C($R^a$)=N—, —O—, —Si($R^a$)$_2$—, —S—, —SO$_2$—, —N($R^a$)—, and >C=Z In some embodiments, Y is selected from the group consisting of: —CH$_2$—, —C($R^a R^b$)—, —CH$_2$CH$_2$—, —C($R^a R^b$)—C($R^a R^b$)—, —CH$_2$CH$_2$CH$_2$—, —C($R^a R^b$) C($R^a R^b$)C($R^a R^b$)—, —C($R^a$)=C($R^b$)—, and —C($R^a$)=N—

In some embodiments, Y is selected from the group consisting of: —CH$_2$—, —CHR$^a$—, —CHCH$_3$—, CR$^a$R$^b$— or —X—Y— together designate a bivalent linker group (also referred to as a radicle) together designate a bivalent linker group consisting of 1, 2, 3 or 4 groups/atoms selected from the group consisting of —C($R^a R^b$)—, —C($R^a$)=C($R^b$)—, —C($R^a$)=N—, —O—, —Si($R^a$)$_2$—, —S—, —SO$_2$—, —N($R^a$)—, and >C=Z, In some embodiments, —X—Y-designates a biradicle selected from the groups consisting of: —X—CH$_2$—, —X—CR$^a$R$^b$—, —X—CHR$^a$—, —X—C(HCH$_3$)⁻, —O—Y—, —O—CH$_2$—, —S—CH$_2$—, —NH—CH$_2$—, —O—CHCH$_3$—, —CH$_2$—O—CH$_2$, —O—CH(CH$_3$CH$_3$)—, —O—CH$_2$—CH$_2$—, OCH$_2$—CH$_2$—CH$_2$—, —O—CH$_2$OCH$_2$—, —O—NCH$_2$—, —C(=CH$_2$)—CH$_2$—, —NR$^a$—CH$_2$—, N—O—CH$_2$, —S—CR$^a$R$^b$— and —S—CHR$^a$—.

In some embodiments —X—Y— designates —O—CH$_2$— or —O—CH(CH$_3$)—.

wherein Z is selected from —O—, —S—, and —N($R^a$)—, and R$^a$ and, when present R$^b$, each is independently selected from hydrogen, optionally substituted C$_{1-6}$-alkyl, optionally substituted C$_{2-6}$-alkenyl, optionally substituted C$_{2-6}$-alkynyl, hydroxy, optionally substituted $C_{1-6}$-alkoxy, $C_{2-6}$-alkoxyalkyl, $C_{2-6}$-alkenyloxy, carboxy, $C_{1-6}$-alkoxycarbonyl, $C_{1-6}$-alkylcarbonyl, formyl, aryl, aryloxy-carbonyl, aryloxy, arylcarbonyl, heteroaryl, heteroaryloxy-carbonyl, heteroaryloxy, heteroarylcarbonyl, amino, mono- and di($C_{1-6}$-alkyl) amino, carbamoyl, mono- and di($C_{1-6}$-alkyl)-aminocarbonyl, amino-$C_{1-6}$-alkyl-aminocarbonyl, mono- and di($C_{1-6}$-alkyl)amino-$C_{1-6}$-alkyl-aminocarbonyl, C1-6-alkyl-carbonylamino, carbamido, $C_{1-6}$-alkanoyloxy, sulphono, $C_{1-6}$-alkylsulphonyloxy, nitro, azido, sulphanyl, $C_{1-6}$-alkylthio, halogen, where aryl and heteroaryl may be optionally substituted and where two geminal substituents $R^a$ and $R^b$ together may designate optionally substituted methylene (=$CH_2$), wherein for all chiral centers, asymmetric groups may be found in either R or S orientation.

wherein $R^1$, $R^2$, $R^3$, $R^5$ and $R^{5*}$ are independently selected from the group consisting of: hydrogen, optionally substituted $C_{1-6}$-alkyl, optionally substituted $C_{2-6}$-alkenyl, optionally substituted $C_{2-6}$-alkynyl, hydroxy, $C_{1-6}$-alkoxy, $C_{2-6}$-alkoxyalkyl, $C_{2-6}$-alkenyloxy, carboxy, $C_{1-6}$-alkoxycarbonyl, $C_{1-6}$-alkylcarbonyl, formyl, aryl, aryloxy-carbonyl, aryloxy, arylcarbonyl, heteroaryl, heteroaryloxy-carbonyl, heteroaryloxy, heteroarylcarbonyl, amino, mono- and di($C_{1-6}$-alkyl) amino, carbamoyl, mono- and di($C_{1-6}$-alkyl)-aminocarbonyl, amino-$C_{1-6}$-alkyl-aminocarbonyl, mono- and di($C_{1-6}$-alkyl)amino-$C_{1-6}$-alkyl-aminocarbonyl, $C_{1-6}$-alkyl-carbonylamino, carbamido, $C_{1-6}$-alkanoyloxy, sulphono, $C_{1-6}$-alkylsulphonyloxy, nitro, azido, sulphanyl, $C_{1-6}$-alkylthio, halogen, where aryl and heteroaryl may be optionally substituted, and where two geminal substituents together may designate oxo, thioxo, imino, or optionally substituted methylene.

In some embodiments $R^1$, $R^2$, $R^3$, $R^5$ and $R^{5*}$ are independently selected from $C_{1-6}$ alkyl, such as methyl, and hydrogen.

In some embodiments $R^1$, $R^2$, $R^3$, $R^5$ and $R^{5*}$ are all hydrogen.

In some embodiments $R^1$, $R^2$, $R^3$, are all hydrogen, and either $R^5$ and $R^{5*}$ is also hydrogen and the other of $R^5$ and $R^{5*}$ is other than hydrogen, such as $C_{1-6}$ alkyl such as methyl.

In some embodiments, $R^a$ is either hydrogen or methyl. In some embodiments, when present, $R^b$ is either hydrogen or methyl.

In some embodiments, one or both of $R^a$ and $R^b$ is hydrogen

In some embodiments, one of $R^a$ and $R^b$ is hydrogen and the other is other than hydrogen In some embodiments, one of $R^a$ and $R^b$ is methyl and the other is hydrogen In some embodiments, both of $R^a$ and $R^b$ are methyl.

In some embodiments, the biradicle —X—Y— is —O—$CH_2$—, W is O, and all of $R^1$, $R^2$, $R^3$, $R^5$ and $R^{5*}$ are all hydrogen. Such LNA nucleosides are disclosed in WO99/014226, WO00/66604, WO98/039352 and WO2004/046160 which are all hereby incorporated by reference, and include what are commonly known as beta-D-oxy LNA and alpha-L-oxy LNA nucleosides.

In some embodiments, the biradicle —X—Y— is —S—$CH_2$—, W is O, and all of $R^1$, $R^2$, $R^3$, $R^5$ and $R^{5*}$ are all hydrogen. Such thio LNA nucleosides are disclosed in WO99/014226 and WO2004/046160 which are hereby incorporated by reference.

In some embodiments, the biradicle —X—Y— is —NH—$CH_2$—, W is O, and all of $R^1$, $R^2$, $R^3$, $R^5$ and $R^{5*}$ are all hydrogen. Such amino LNA nucleosides are disclosed in WO99/014226 and WO2004/046160 which are hereby incorporated by reference.

In some embodiments, the biradicle —X—Y— is —O—$CH_2$—$CH_2$— or —O—$CH_2$—$CH_2$—$CH_2$—, W is O, and all of $R^1$, $R^2$, $R^3$, $R^5$ and $R^{5*}$ are all hydrogen. Such LNA nucleosides are disclosed in WO00/047599 and Morita et al, Bioorganic & Med. Chem. Lett. 12 73-76, which are hereby incorporated by reference, and include what are commonly known as 2'-O-4'C-ethylene bridged nucleic acids (ENA).

In some embodiments, the biradicle —X—Y— is —O—$CH_2$—, W is O, and all of $R^1$, $R^2$, $R^3$, and one of $R^5$ and $R^{5*}$ are hydrogen, and the other of $R^5$ and $R^{5*}$ is other than hydrogen such as $C_{1-6}$ alkyl, such as methyl. Such 5' substituted LNA nucleosides are disclosed in WO2007/134181 which is hereby incorporated by reference.

In some embodiments, the biradicle —X—Y— is —O—$CR^aR^b$—, wherein one or both of $R^a$ and $R^b$ are other than hydrogen, such as methyl, W is O, and all of $R^1$, $R^2$, $R^3$, and one of $R^5$ and $R^{5*}$ are hydrogen, and the other of $R^5$ and $R^{5*}$ is other than hydrogen such as $C_{1-6}$ alkyl, such as methyl. Such bis modified LNA nucleosides are disclosed in WO2010/077578 which is hereby incorporated by reference.

In some embodiments, the biradicle —X—Y— designate the bivalent linker group-O—CH($CH_2OCH_3$)-(2' O-methoxyethyl bicyclic nucleic acid-Seth at al., 2010, J. Org. Chem. Vol 75 (5) pp. 1569-81). In some embodiments, the biradicle —X—Y— designate the bivalent linker group-O—CH($CH_2CH_3$)-(2'O-ethyl bicyclic nucleic acid-Seth at al., 2010, J. Org. Chem. Vol 75 (5) pp. 1569-81). In some embodiments, the biradicle —X—Y— is —O—$CHR^a$—, W is O, and all of $R^1$, $R^2$, $R^3$, $R^5$ and $R^{5*}$ are all hydrogen. Such 6' substituted LNA nucleosides are disclosed in WO10036698 and WO07090071 which are both hereby incorporated by reference.

In some embodiments, the biradicle —X—Y— is —O—CH($CH_2OCH_3$)—, W is O, and all of $R^1$, $R^2$, $R^3$, $R^5$ and $R^{5*}$ are all hydrogen. Such LNA nucleosides are also known as cyclic MOEs in the art (cMOE) and are disclosed in WO07090071.

In some embodiments, the biradicle —X—Y— designate the bivalent linker group —O—CH($CH_3$)—. —in either the R- or S-configuration. In some embodiments, the biradicle —X—Y— together designate the bivalent linker group —O—$CH_2$—O—$CH_2$—(Seth at al., 2010, J. Org. Chem). In some embodiments, the biradicle —X—Y— is —O—CH($CH_3$)—, W is O, and all of $R^1$, $R^2$, $R^3$, $R^5$ and $R^{5*}$ are all hydrogen. Such 6' methyl LNA nucleosides are also known as cET nucleosides in the art, and may be either(S)cET or (R)cET stereoisomers, as disclosed in WO07090071 (beta-D) and WO2010/036698 (alpha-L) which are both hereby incorporated by reference).

In some embodiments, the biradicle —X—Y— is —O—$CR^aR^b$—, wherein in neither $R^a$ or $R^b$ is hydrogen, W is O, and all of $R^1$, $R^2$, $R^3$, $R^5$ and $R^{5*}$ are all hydrogen. In some embodiments, $R^a$ and $R^b$ are both methyl. Such 6' di-substituted LNA nucleosides are disclosed in WO 2009006478 which is hereby incorporated by reference.

In some embodiments, the biradicle —X—Y— is —S—$CHR^a$—, W is O, and all of $R^1$, $R^2$, $R^3$, $R^5$ and $R^{5*}$ are all hydrogen. Such 6' substituted thio LNA nucleosides are disclosed in WO11156202 which is hereby incorporated by reference. In some 6' substituted thio LNA embodiments $R^a$ is methyl.

In some embodiments, the biradicle —X—Y— is —C(=$CH_2$)—C($R^aR^b$)—, such as —C(=$CH_2$)—$CH_2$—, or —C(=$CH_2$)—CH($CH_3$)—W is O, and all of $R^1$, $R^2$, $R^3$, $R^5$ and $R^{5*}$ are all hydrogen. Such vinyl carbo LNA nucleosides are disclosed in WO08154401 and WO09067647 which are both hereby incorporated by reference.

In some embodiments the biradicle —X—Y— is —N(—OR$^a$)—, W is O, and all of $R^1$, $R^2$, $R^3$, $R^5$ and $R^{5*}$ are all hydrogen. In some embodiments $R^a$ is $C_{1-6}$ alkyl such as methyl. Such LNA nucleosides are also known as N substituted LNAs and are disclosed in WO2008/150729, which is hereby incorporated by reference. In some embodiments, the biradicle —X—Y— together designate the bivalent linker group —O—NR$^a$—CH$_3$— (Seth at al., 2010, J. Org. Chem). In some embodiments the biradicle —X—Y— is —N(R$^a$)—, W is O, and all of $R^1$, $R^2$, $R^3$, $R^5$ and $R^{5*}$ are all hydrogen. In some embodiments $R^a$ is $C_{1-6}$ alkyl such as methyl.

In some embodiments, one or both of $R^5$ and $R^{5*}$ is hydrogen and, when substituted the other of $R^5$ and $R^{5*}$ is $C_{1-6}$ alkyl such as methyl. In such an embodiment, $R^1$, $R^2$, $R^3$, may all be hydrogen, and the biradicle —X—Y— may be selected from —O—CH2- or —O—C(HCR$^a$)—, such as —O—C(HCH3)-.

In some embodiments, the biradicle is —CR$^a$R$^b$—O—CR$^a$R$^b$—, such as CH$_2$—O—CH$_2$—, W is O and all of $R^1$, $R^2$, $R^3$, $R^5$ and $R^{5*}$ are all hydrogen. In some embodiments $R^a$ is C16 alkyl such as methyl. Such LNA nucleosides are also known as conformationally restricted nucleotides (CRNs) and are disclosed in WO2013036868 which is hereby incorporated by reference.

In some embodiments, the biradicle is —O—CR$^a$R$^b$—O—CR$^a$R$^b$—, such as O—CH$_2$—O—CH$_2$—, W is O and all of $R^1$, $R^2$, $R^3$, $R^5$ and $R^{5*}$ are all hydrogen. In some embodiments $R^a$ is $C_{1-6}$ alkyl such as methyl. Such LNA nucleosides are also known as COC nucleotides and are disclosed in Mitsuoka et al., Nucleic Acids Research 2009 37 (4), 1225-1238, which is hereby incorporated by reference.

It will be recognized than, unless specified, the LNA nucleosides may be in the beta-D or alpha-L stereoisoform.

Certain examples of LNA nucleosides are presented in Scheme 1.

Scheme 1

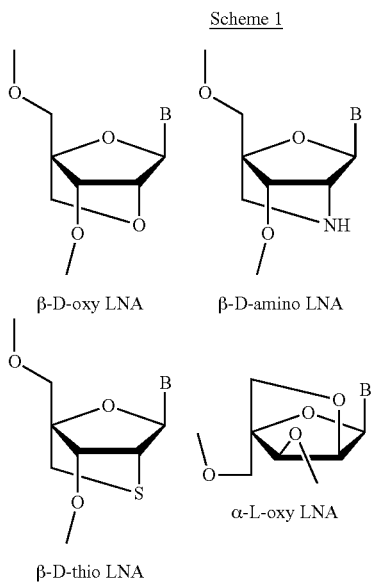

β-D-oxy LNA   β-D-amino LNA

β-D-thio LNA   α-L-oxy LNA

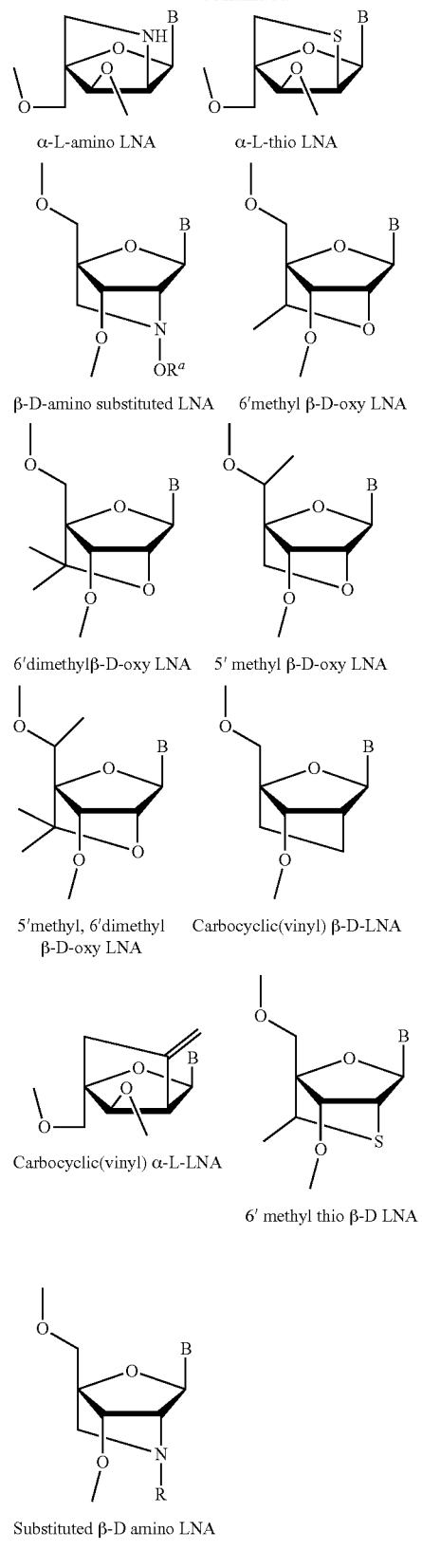

α-L-amino LNA   α-L-thio LNA

β-D-amino substituted LNA   6′methyl β-D-oxy LNA

6′dimethylβ-D-oxy LNA   5′ methyl β-D-oxy LNA

5′methyl, 6′dimethyl β-D-oxy LNA   Carbocyclic(vinyl) β-D-LNA

Carbocyclic(vinyl) α-L-LNA

6′ methyl thio β-D LNA

Substituted β-D amino LNA

As illustrated in the examples, in some embodiments of the invention the LNA nucleosides in the oligonucleotides are beta-D-oxy-LNA nucleosides.

Nuclease Mediated Degradation

Nuclease mediated degradation refers to an oligonucleotide capable of mediating degradation of a complementary nucleotide sequence when forming a duplex with such a sequence.

In some embodiments, the oligonucleotide may function via nuclease mediated degradation of the target nucleic acid, where the oligonucleotides of the invention are capable of recruiting a nuclease, particularly and endonuclease, preferably endoribonuclease (RNase), such as RNase H. Examples of oligonucleotide designs which operate via nuclease mediated mechanisms are oligonucleotides which typically comprise a region of at least 5 or 6 DNA nucleosides and are flanked on one side or both sides by affinity enhancing nucleosides, for example gapmers, headmers and tailmers.

RNase H Activity and Recruitment

The RNase H activity of an antisense oligonucleotide refers to its ability to recruit RNase H when in a duplex with a complementary RNA molecule. WO01/23613 provides in vitro methods for determining RNaseH activity, which may be used to determine the ability to recruit RNaseH. Typically an oligonucleotide is deemed capable of recruiting RNase H if it, when provided with a complementary target nucleic acid sequence, has an initial rate, as measured in pmol/l/min, of at least 5%, such as at least 10% or more than 20% of the of the initial rate determined when using a oligonucleotide having the same base sequence as the modified oligonucleotide being tested, but containing only DNA monomers with phosphorothioate linkages between all monomers in the oligonucleotide, and using the methodology provided by Example 91-95 of WO01/23613 (hereby incorporated by reference).

Gapmer

The term gapmer as used herein refers to an antisense oligonucleotide which comprises a region of RNase H recruiting oligonucleotides (gap) which is flanked 5' and 3' by regions which comprise one or more affinity enhancing modified nucleosides (flanks or wings). Various gapmer designs are described herein and a characterized by their ability to recruit RNaseH. Headmers and tailmers are oligonucleotides capable of recruiting RNase H where one of the flanks is missing, i.e. only one of the ends of the oligonucleotide comprises affinity enhancing modified nucleosides. For headmers the 3' flank is missing (i.e. the 5' flank comprises affinity enhancing modified nucleosides) and for tailmers the 5' flank is missing (i.e. the 3' flank comprises affinity enhancing modified nucleosides).

LNA Gapmer

The term LNA gapmer is a gapmer oligonucleotide wherein at least one of the affinity enhancing modified nucleosides is an LNA nucleoside.

Mixed Wing Gapmer

The term mixed wing gapmer or mixed flank gapmer refers to a LNA gapmer wherein at least one of the flank regions comprise at least one LNA nucleoside and at least one non-LNA modified nucleoside, such as at least one 2' substituted modified nucleoside, such as, for example, 2'-O-alkyl-RNA, 2'-O-methyl-RNA, 2'-alkoxy-RNA, 2'-O-methoxyethyl-RNA (MOE), 2'-amino-DNA, 2'-Fluoro-RNA and 2'-F-ANA nucleoside(s). In some embodiments the mixed wing gapmer has one flank which comprises only LNA nucleosides (e.g. 5' or 3') and the other flank (3' or 5' respectfully) comprises 2' substituted modified nucleoside(s) and optionally LNA nucleosides.

Gapbreaker

The term "gapbreaker oligonucleotide" is used in relation to a gapmer capable of maintaining RNAseH recruitment even though the gap region is disrupted by a non-RNaseH recruiting nucleoside (a gap-breaker nucleoside, E) such that the gap region comprise less than 5 consecutive DNA nucleosides. Non-RNaseH recruiting nucleosides are for example nucleosides in the 3' endo conformation, such as LNA's where the bridge between C2' and C4' of the ribose sugar ring of a nucleoside is in the beta conformation, such as beta-D-oxy LNA or ScET nucleoside. The ability of gapbreaker oligonucleotide to recruit RNaseH is typically sequence or even compound specific-see Rukov et al. 2015 Nucl. Acids Res. Vol. 43 pp. 8476-8487, which discloses "gapbreaker" oligonucleotides which recruit RNaseH which in some instances provide a more specific cleavage of the target RNA.

In some embodiments, the oligonucleotide of the invention is a gapbreaker oligonucleotide. In some embodiments the gapbreaker oligonucleotide comprise a 5'-flank (F), a gap (G) and a 3'-flank (F'), wherein the gap is disrupted by a non-RNaseH recruiting nucleoside (a gap-breaker nucleoside, E) such that the gap contain at least 3 or 4 consecutive DNA nucleosides. In some embodiments the gapbreaker nucleoside (E) is an LNA nucleoside where the bridge between C2' and C4' of the ribose sugar ring of a nucleoside is in the beta conformation and is placed within the gap region such that the gap-breaker LNA nucleoside is flanked 5' and 3' by at least 3 (5') and 3 (3') or at least 3 (5') and 4 (3') or at least 4 (5') and 3 (3') DNA nucleosides, and wherein the oligonucleotide is capable of recruiting RNaseH.

The gapbreaker oligonucleotide can be represented by the following formulae:

F-G-E-G-F'; in particular $F_{1-7}$-$G_{3-4}$-$E_1$-$G_{3-4}$-$F'_{1-7}$

D'-F-G-F', in particular $D'_{1-3}$-$F_{1-7}$-$G_{3-4}$-$E_1$-$G_{3-4}$-$F'_{1-7}$ F-G-F'-D", in particular $F_{1-7}$-$G_{3-4}$-$E_1$-$G_{3-4}$-$F'_{1-7}$-$D''_{1-3}$ D'-F-G-F'-D", in particular $D'_{1-3}$-$F_{1-7}$-$G_{3-4}$-$E_1$-$G_{3-4}$-$F'_{1-7}$-$D''_{1-3}$ Where region D' and D" are as described in the section "Gapmer design".

In some embodiments the gapbreaker nucleoside (E) is a beta-D-oxy LNA or ScET or another beta-LNA nucleosides shown in Scheme 1).

Conjugate

The term conjugate as used herein refers to an oligonucleotide which is covalently linked to a non-nucleotide moiety (conjugate moiety or region C or third region), also termed a oligonucleotide conjugate.

Conjugation of the oligonucleotides of the invention to one or more non-nucleotide moieties may improve the pharmacology of the oligonucleotide, e.g. by affecting the activity, cellular distribution, cellular uptake or stability of the oligonucleotide. In some embodiments the conjugate moiety targets the oligonucleotide to the liver. A the same time the conjugate serve to reduce activity of the oligonucleotide in non-target cell types, tissues or organs, e.g. off target activity or activity in non-target cell types, tissues or organs. In one embodiment of the invention the oligonucleotide conjugate of the invention display improved inhibition of PD-L1 in the target cell when compared to an unconjugated oligonucleotide. In another embodiment the oligonucleotide conjugate of the invention has improved cellular distribution between liver and other organs, such as spleen or kidney (i.e. more conjugated oligonucleotide goes to the liver than the spleen or kidney) when compared to an unconjugated oligonucleotide. In another embodiment the oligonucleotide conjugate of the invention show improved cellular uptake into the liver of the conjugate oligonucleotide when compared to an unconjugated oligonucleotide.

WO 93/07883 and WO2013/033230 provides suitable conjugate moieties, which are hereby incorporated by reference. Further suitable conjugate moieties are those capable of binding to the asialoglycoprotein receptor (ASGPr). In particular tri-valent N-acetylgalactosamine conjugate moieties are suitable for binding to the the ASGPr, see for example WO 2014/076196, WO 2014/207232 and WO 2014/179620 (hereby incorporated by reference). The conjugate moiety is essentially the part of the antisense oligonucleotides conjugates which is not composed of nucleic acids.

Oligonucleotide conjugates and their synthesis has also been reported in comprehensive reviews by Manoharan in Antisense Drug Technology, Principles, Strategies, and Applications, S. T. Crooke, ed., Ch. 16, Marcel Dekker, Inc., 2001 and Manoharan, Antisense and Nucleic Acid Drug Development, 2002, 12, 103, each of which is incorporated herein by reference in its entirety.

In an embodiment, the non-nucleotide moiety (conjugate moiety) is selected from the group consisting of carbohydrates, cell surface receptor ligands, drug substances, hormones, lipophilic substances, polymers, proteins, peptides, toxins (e.g. bacterial toxins), vitamins, viral proteins (e.g. capsids) or combinations thereof.

Linkers

A linkage or linker is a connection between two atoms that links one chemical group or segment of interest to another chemical group or segment of interest via one or more covalent bonds. Conjugate moieties can be attached to the oligonucleotide directly or through a linking moiety (e.g. linker or tether). Linkers serve to covalently connect a third region, e.g. a conjugate moiety (Region C), to a first region, e.g. an oligonucleotide or contiguous nucleotide sequence complementary to the target nucleic acid (region A).

In some embodiments of the invention the conjugate or oligonucleotide conjugate of the invention may optionally, comprise a linker region (second region or region B and/or region Y) which is positioned between the oligonucleotide or contiguous nucleotide sequence complementary to the target nucleic acid (region A or first region) and the conjugate moiety (region C or third region).

Region B refers to biocleavable linkers comprising or consisting of a physiologically labile bond that is cleavable under conditions normally encountered or analogous to those encountered within a mammalian body. Conditions under which physiologically labile linkers undergo chemical transformation (e.g., cleavage) include chemical conditions such as pH, temperature, oxidative or reductive conditions or agents, and salt concentration found in or analogous to those encountered in mammalian cells. Mammalian intracellular conditions also include the presence of enzymatic activity normally present in a mammalian cell such as from proteolytic enzymes or hydrolytic enzymes or nucleases. In one embodiment the biocleavable linker is susceptible to S1 nuclease cleavage. In a preferred embodiment the nuclease susceptible linker comprises between 1 and 10 nucleosides, such as 1, 2, 3, 4, 5, 6, 7, 8, 9 or 10 nucleosides, more preferably between 2 and 6 nucleosides and most preferably between 2 and 4 linked nucleosides comprising at least two consecutive phosphodiester linkages, such as at least 3 or 4 or 5 consecutive phosphodiester linkages. Preferably the nucleosides are DNA or RNA. Phosphodiester containing biocleavable linkers are described in more detail in WO 2014/076195 (hereby incorporated by reference).

Region Y refers to linkers that are not necessarily biocleavable but primarily serve to covalently connect a conjugate moiety (region C or third region), to an oligonucleotide or contiguous nucleotide sequence complementary to the target nucleic acid (region A or first region). The region Y linkers may comprise a chain structure or an oligomer of repeating units such as ethylene glycol, amino acid units or amino alkyl groups The oligonucleotide conjugates of the present invention can be constructed of the following regional elements A-C, A-B-C, A-B-Y-C, A-Y-B-C or A-Y-C. In some embodiments the linker (region Y) is an amino alkyl, such as a C2-C36 amino alkyl group, including, for example C6 to C12 amino alkyl groups. In a preferred embodiment the linker (region Y) is a C6 amino alkyl group.

Treatment

The term 'treatment' as used herein refers to both treatment of an existing disease (e.g. a disease or disorder as herein referred to), or prevention of a disease, i.e. prophylaxis. It will therefore be recognized that treatment as referred to herein may, in some embodiments, be prophylactic.

Restoration of Immune Response Against Pathogens

The immune response is divided into the innate and adaptive immune response. The innate immune system provides an immediate, but non-specific response. The adaptive immune response is activated by innate immune response and is highly specific to a particular pathogen. Upon presentation of a pathogen-derived antigen on the surface of antigen-presenting cells, immune cells of the adaptive immune response (i.e. T and B lymphocytes) are activated through their antigen-specific receptors leading to a pathogenic-specifc immune response and development of immunological memory. Chronic viral infections, such as HBV and HCV, are associated with T cell exhaustion characterized by unresponsiveness of the viral-specific T cells. T cell exhaustion is well studied, for a review see for example Yi et al 2010 Immunology 129, 474-481. Chronic viral infections are also associated with reduced function of NK cells that are innate immune cells. Enhancing viral immune response is important for clearance of chronic infection. Restoration of immune response against pathogens, mediated by T cells and NK cells, can be assessed by measurement of proliferation, cytokine secretion and cytolytic function (Dolina et al. 2013 Molecular Therapy-Nucleic Acids, 2 e72 and Example 6 herein).

DETAILED DESCRIPTION OF THE INVENTION

The present invention relates to the use of antisense oligonucleotides and conjugates thereof and pharmaceutical compositions comprising these to restore immune response against pathogens that have infected an animal, in particular a human. The antisense oligonucleotide conjugates of the present invention are particular useful against pathogens that have infected the liver, in particular chronic liver infections like HBV. The conjugates allow targeted distribution of the oligonucleotides and prevents systemic knockdown of the target nucleic acid.

The Oligonucleotides of the Invention

The invention relates to oligonucleotides capable of modulating expression of PD-L1. The modulation is may achieved by hybridizing to a target nucleic acid encoding PD-L1 or which is involved in the regulation of PD-L1. The target nucleic acid may be a mammalian PD-L1 sequence, such as a sequence selected from the group consisting of SEQ ID NO: 1, SEQ ID NO: 2 and/or SEQ ID NO: 3. The target nucleic acid may be a pre-mRNA, an mRNA or any RNA sequence expressed from a mammalian cell that supports the expression or regulation of PD-L1.

The oligonucleotide of the invention is an antisense oligonucleotide which targets PD-L1.

In one aspect of the invention the oligonucleotides of the invention are conjugated to a conjugate moiety, in particular an asialoglycoprotein receptor targeting conjugate moiety.

In some embodiments the antisense oligonucleotide of the invention is capable of modulating the expression of the target by inhibiting or down-regulating it. Preferably, such modulation produces an inhibition of expression of at least 20% compared to the normal expression level of the target, more preferably at least 30%, 40%, 50%, 60%, 70%, 80%, or 90% inhibition compared to the normal expression level of the target. Preferably, such modulation produces an inhibition of expression of at least 20% compared to the expression level when the cell or organism is challenged by an infectious agent, or treated with an agent simulating the challenge by an infectious agent (eg poly I:C or LPS), more preferably at least 30%, 40%, 50%, 60%, 70%, 80%, or 90% inhibition compared to the expression level when the cell or organism is challenged by an infectious agent, or treated with an agent simulating the challenge by an infectious agent (eg poly I:C or LPS). In some embodiments oligonucleotides of the invention may be capable of inhibiting expression levels of PD-L1 mRNA by at least 60% or 70% in vitro using KARPAS-299 or THP1 cells. In some embodiments compounds of the invention may be capable of inhibiting expression levels of PD-L1 protein by at least 50% in vitro using KARPAS-299 or THP1 cells. Suitably, the examples provide assays which may be used to measure PD-L1 RNA (e.g. example 1). The target modulation is triggered by the hybridization between a contiguous nucleotide sequence of the oligonucleotide and the target nucleic acid. In some embodiments the oligonucleotide of the invention comprises mismatches between the oligonucleotide and the target nucleic acid. Despite mismatches, hybridization to the target nucleic acid may still be sufficient to show a desired modulation of PD-L1 expression. Reduced binding affinity resulting from mismatches may advantageously be compensated by increased number of nucleotides in the oligonucleotide and/or an increased number of modified nucleosides capable of increasing the binding affinity to the target, such as 2' modified nucleosides, including LNA, present within the oligonucleotide sequence.

In some embodiments the antisense oligonucleotide of the invention is capable of restoring pathogen-specific T cells. In some embodiments, oligonucleotides of the invention are capable of increasing the pathogen-specific T cells by at least 40%, 50%, 60% or 70% when compared to untreated controls or controls treated with standard of care. In one embodiment the antisense oligonucleotide or conjugate of the invention is capable increasing HBV-specific T cells when compared to untreated controls or controls treated with standard of care. Suitably, the examples provide assays which may be used to measure the HBV-specific T cells (e.g. T cell proliferation, cytokine secretion and cytolytic activity). In another embodiment the the antisense oligonucleotide or conjugate of the invention is capable increasing HCV-specific T cells when compared to untreated controls or controls treated with standard of care. In another embodiment the the antisense oligonucleotide or conjugate of the invention is capable increasing HDV-specific T cells when compared to untreated controls or controls treated with standard of care.

In some embodiments the antisense oligonucleotide of the invention is capable reducing HBsAg levels in an animal or human. In some embodiments, oligonucleotides of the invention are capable of reducing the HBsAg levels by at least 40%, 50%, 60% or 70%, more preferably by at least 80%, 90% or 95% when compared to the level prior to treatment. Most preferably oligonucleotides of the invention are capable of achieving seroconversion of HBsAg in an animal or human infected with HBV.

An aspect of the present invention relates to an antisense oligonucleotide which comprises a contiguous nucleotide sequence of 10 to 30 nucleotides in length with at least 90% complementarity to a PD-L1 target nucleic acid.

In some embodiments, the oligonucleotide comprises a contiguous sequence which is at least 90% complementary, such as at least 91%, such as at least 92%, such as at least 93%, such as at least 94%, such as at least 95%, such as at least 96%, such as at least 97%, such as at least 98%, or 100% complementary with a region of the target nucleic acid.

In a preferred embodiment the oligonucleotide of the invention, or contiguous nucleotide sequence thereof is fully complementary (100% complementary) to a region of the target nucleic acid, or in some embodiments may comprise one or two mismatches between the oligonucleotide and the target nucleic acid.

In some embodiments the oligonucleotide comprises a contiguous nucleotide sequence of 10 to 30 nucleotides in length with at least 90% complementary, such as fully (or 100%) complementary, to a region target nucleic acid region present in SEQ ID NO: 1 or SEQ ID NO: 2. In some embodiments the oligonucleotide sequence is 100% complementary to a corresponding target nucleic acid region present SEQ ID NO: 1 and SEQ ID NO: 2. In some embodiments the oligonucleotide sequence is 100% complementary to a corresponding target nucleic acid region present SEQ ID NO: 1 and SEQ ID NO: 3.

In some embodiments, the oligonucleotide or oligonucleotide conjugate comprises a contiguous nucleotide sequence of 10 to 30 nucleotides in length with at least 90% complementary, such as 100% complementarity, to a corresponding target nucleic acid region wherein the contiguous nucleotide sequence is complementary to a sub-sequence of the target nucleic acid selected from the group consisting of position 371-3068, 5467-12107 and 15317-19511 on SEQ ID NO: 1. In a further embodiment the sub-sequence of the target nucleic acid is selected from the group consisting of position 371-510, 822-1090, 1992-3068, 5467-5606, 6470-12107, 15317-15720, 15317-18083, 18881-19494 and 1881-19494 on SEQ ID NO: 1. In a preferred embodiment the sub-sequence of the target nucleic acid is selected from the group consisting of position 7300-7333, 8028-8072, 9812-9859, 11787-11873 and 15690-15735 on SEQ ID NO: 1.

In some embodiments, the oligonucleotide or oligonucleotide conjugate comprises a contiguous nucleotide sequence of 10 to 30 nucleotides in length with at least 90% complementary, such as 100% complementarity, to a corresponding target nucleic acid region present in SEQ ID NO: 1, wherein the target nucleic acid region is selected from the group consisting of region a1 to a449 in table 4.

TABLE 4

Regions of SEQ ID NO 1 which may be targeted using oligonucleotide of the invention

| Reg. a | Position in SEQ ID NO 1 from | to | Length |
|---|---|---|---|
| a1 | 51 | 82 | 32 |
| a2 | 87 | 116 | 30 |
| a3 | 118 | 133 | 16 |
| a4 | 173 | 206 | 34 |
| a5 | 221 | 287 | 67 |
| a6 | 304 | 350 | 47 |
| a7 | 354 | 387 | 34 |
| a8 | 389 | 423 | 35 |
| a9 | 425 | 440 | 16 |
| a10 | 452 | 468 | 17 |
| a11 | 470 | 484 | 15 |
| a12 | 486 | 500 | 15 |
| a13 | 503 | 529 | 27 |
| a14 | 540 | 574 | 35 |
| a15 | 576 | 649 | 74 |
| a16 | 652 | 698 | 47 |
| a17 | 700 | 750 | 51 |
| a18 | 744 | 758 | 15 |
| a19 | 774 | 801 | 28 |
| a20 | 805 | 820 | 16 |
| a21 | 827 | 891 | 65 |
| a22 | 915 | 943 | 29 |
| a23 | 950 | 982 | 33 |
| a24 | 984 | 1000 | 17 |
| a25 | 1002 | 1054 | 53 |
| a26 | 1060 | 1118 | 59 |
| a27 | 1124 | 1205 | 82 |
| a28 | 1207 | 1255 | 49 |
| a29 | 1334 | 1349 | 16 |
| a30 | 1399 | 1425 | 27 |
| a31 | 1437 | 1458 | 22 |
| a32 | 1460 | 1504 | 45 |
| a33 | 1548 | 1567 | 20 |
| a34 | 1569 | 1586 | 18 |
| a35 | 1608 | 1662 | 55 |
| a36 | 1677 | 1700 | 24 |
| a37 | 1702 | 1721 | 20 |
| a38 | 1723 | 1745 | 23 |
| a39 | 1768 | 1794 | 27 |
| a40 | 1820 | 1835 | 16 |
| a41 | 1842 | 1874 | 33 |
| a42 | 1889 | 1979 | 91 |
| a43 | 1991 | 2011 | 21 |
| a44 | 2013 | 2038 | 26 |
| a45 | 2044 | 2073 | 30 |
| a46 | 2075 | 2155 | 81 |
| a47 | 2205 | 2228 | 24 |
| a48 | 2253 | 2273 | 21 |
| a49 | 2275 | 2303 | 29 |
| a50 | 2302 | 2333 | 32 |
| a51 | 2335 | 2366 | 32 |
| a52 | 2368 | 2392 | 25 |
| a53 | 2394 | 2431 | 38 |
| a54 | 2441 | 2455 | 15 |
| a55 | 2457 | 2494 | 38 |
| a56 | 2531 | 2579 | 49 |
| a57 | 2711 | 2732 | 22 |
| a58 | 2734 | 2757 | 24 |
| a59 | 2772 | 2786 | 15 |
| a60 | 2788 | 2819 | 32 |
| a61 | 2835 | 2851 | 17 |
| a62 | 2851 | 2879 | 29 |
| a63 | 2896 | 2912 | 17 |
| a64 | 2915 | 2940 | 26 |
| a65 | 2944 | 2973 | 30 |
| a66 | 2973 | 2992 | 20 |
| a67 | 2998 | 3016 | 19 |
| a68 | 3018 | 3033 | 16 |
| a69 | 3036 | 3051 | 16 |
| a70 | 3114 | 3139 | 26 |
| a71 | 3152 | 3173 | 22 |
| a72 | 3181 | 3203 | 23 |
| a73 | 3250 | 3271 | 22 |
| a74 | 3305 | 3335 | 31 |
| a75 | 3346 | 3363 | 18 |
| a76 | 3391 | 3446 | 56 |
| a77 | 3448 | 3470 | 23 |
| a78 | 3479 | 3497 | 19 |
| a79 | 3538 | 3554 | 17 |
| a80 | 3576 | 3597 | 22 |
| a81 | 3603 | 3639 | 37 |
| a82 | 3663 | 3679 | 17 |
| a83 | 3727 | 3812 | 86 |
| a84 | 3843 | 3869 | 27 |
| a85 | 3874 | 3904 | 31 |
| a86 | 3926 | 3955 | 30 |
| a87 | 3974 | 3993 | 20 |
| a88 | 3995 | 4042 | 48 |
| a89 | 4053 | 4073 | 21 |
| a90 | 4075 | 4123 | 49 |
| a91 | 4133 | 4157 | 25 |
| a92 | 4158 | 4188 | 31 |
| a93 | 4218 | 4250 | 33 |
| a94 | 4277 | 4336 | 60 |
| a95 | 4353 | 4375 | 23 |
| a96 | 4383 | 4398 | 16 |
| a97 | 4405 | 4446 | 42 |
| a98 | 4448 | 4464 | 17 |
| a99 | 4466 | 4493 | 28 |
| a100 | 4495 | 4558 | 64 |
| a101 | 4571 | 4613 | 43 |
| a102 | 4624 | 4683 | 60 |
| a103 | 4743 | 4759 | 17 |
| a104 | 4761 | 4785 | 25 |
| a105 | 4811 | 4858 | 48 |
| a106 | 4873 | 4932 | 60 |
| a107 | 4934 | 4948 | 15 |
| a108 | 4955 | 4974 | 20 |
| a109 | 4979 | 5010 | 32 |
| a110 | 5012 | 5052 | 41 |
| a111 | 5055 | 5115 | 61 |
| a112 | 5138 | 5166 | 29 |
| a113 | 5168 | 5198 | 31 |
| a114 | 5200 | 5222 | 23 |
| a115 | 5224 | 5284 | 61 |
| a116 | 5286 | 5302 | 17 |
| a117 | 5317 | 5332 | 16 |
| a118 | 5349 | 5436 | 88 |
| a119 | 5460 | 5512 | 53 |
| a120 | 5514 | 5534 | 21 |
| a121 | 5548 | 5563 | 16 |
| a122 | 5565 | 5579 | 15 |
| a123 | 5581 | 5597 | 17 |
| a124 | 5600 | 5639 | 40 |
| a125 | 5644 | 5661 | 18 |
| a126 | 5663 | 5735 | 73 |
| a127 | 5737 | 5770 | 34 |
| a128 | 5778 | 5801 | 24 |
| a129 | 5852 | 5958 | 107 |
| a130 | 6007 | 6041 | 35 |
| a131 | 6049 | 6063 | 15 |
| a132 | 6065 | 6084 | 20 |
| a133 | 6086 | 6101 | 16 |
| a134 | 6119 | 6186 | 68 |
| a135 | 6189 | 6234 | 46 |
| a136 | 6236 | 6278 | 43 |
| a137 | 6291 | 6312 | 22 |
| a138 | 6314 | 6373 | 60 |
| a139 | 6404 | 6447 | 44 |
| a140 | 6449 | 6482 | 34 |
| a141 | 6533 | 6555 | 23 |
| a142 | 6562 | 6622 | 61 |
| a143 | 6624 | 6674 | 51 |
| a144 | 6679 | 6762 | 84 |
| a145 | 6764 | 6780 | 17 |
| a146 | 6782 | 6822 | 41 |

TABLE 4-continued

Regions of SEQ ID NO 1 which may be targeted using oligonucleotide of the invention

| Reg. a | Position in SEQ ID NO 1 from | to | Length |
|---|---|---|---|
| a147 | 6824 | 6856 | 33 |
| a148 | 6858 | 6898 | 41 |
| a149 | 6906 | 6954 | 49 |
| a150 | 6969 | 6992 | 24 |
| a151 | 6994 | 7020 | 27 |
| a152 | 7033 | 7048 | 16 |
| a153 | 7050 | 7066 | 17 |
| a154 | 7078 | 7094 | 17 |
| a155 | 7106 | 7122 | 17 |
| a156 | 7123 | 7144 | 22 |
| a157 | 7146 | 7166 | 21 |
| a158 | 7173 | 7193 | 21 |
| a159 | 7233 | 7291 | 59 |
| a160 | 7300 | 7333 | 34 |
| a161 | 7336 | 7351 | 16 |
| a162 | 7353 | 7373 | 21 |
| a163 | 7375 | 7412 | 38 |
| a164 | 7414 | 7429 | 16 |
| a165 | 7431 | 7451 | 21 |
| a166 | 7453 | 7472 | 20 |
| a167 | 7474 | 7497 | 24 |
| a168 | 7517 | 7532 | 16 |
| a169 | 7547 | 7601 | 55 |
| a170 | 7603 | 7617 | 15 |
| a171 | 7632 | 7647 | 16 |
| a172 | 7649 | 7666 | 18 |
| a173 | 7668 | 7729 | 62 |
| a174 | 7731 | 7764 | 34 |
| a175 | 7767 | 7817 | 51 |
| a176 | 7838 | 7860 | 23 |
| a177 | 7862 | 7876 | 15 |
| a178 | 7880 | 7944 | 65 |
| a179 | 7964 | 8012 | 49 |
| a180 | 8028 | 8072 | 45 |
| a181 | 8086 | 8100 | 15 |
| a182 | 8102 | 8123 | 22 |
| a183 | 8125 | 8149 | 25 |
| a184 | 8151 | 8199 | 49 |
| a185 | 8218 | 8235 | 18 |
| a186 | 8237 | 8276 | 40 |
| a187 | 8299 | 8344 | 46 |
| a188 | 8346 | 8436 | 91 |
| a189 | 8438 | 8470 | 33 |
| a190 | 8472 | 8499 | 28 |
| a191 | 8505 | 8529 | 25 |
| a192 | 8538 | 8559 | 22 |
| a193 | 8562 | 8579 | 18 |
| a194 | 8581 | 8685 | 105 |
| a195 | 8688 | 8729 | 42 |
| a196 | 8730 | 8751 | 22 |
| a197 | 8777 | 8800 | 24 |
| a198 | 8825 | 8865 | 41 |
| a199 | 8862 | 8894 | 33 |
| a200 | 8896 | 8911 | 16 |
| a201 | 8938 | 8982 | 45 |
| a202 | 8996 | 9045 | 50 |
| a203 | 9048 | 9070 | 23 |
| a204 | 9072 | 9139 | 68 |
| a205 | 9150 | 9168 | 19 |
| a206 | 9170 | 9186 | 17 |
| a207 | 9188 | 9202 | 15 |
| a208 | 9204 | 9236 | 33 |
| a209 | 9252 | 9283 | 32 |
| a210 | 9300 | 9331 | 32 |
| a211 | 9339 | 9354 | 16 |
| a212 | 9370 | 9398 | 29 |
| a213 | 9400 | 9488 | 89 |
| a214 | 9490 | 9537 | 48 |
| a215 | 9611 | 9695 | 85 |
| a216 | 9706 | 9721 | 16 |
| a217 | 9723 | 9746 | 24 |
| a218 | 9748 | 9765 | 18 |
| a219 | 9767 | 9788 | 22 |
| a220 | 9794 | 9808 | 15 |
| a221 | 9812 | 9859 | 48 |
| a222 | 9880 | 9913 | 34 |
| a223 | 9923 | 9955 | 33 |
| a224 | 9966 | 10007 | 42 |
| a225 | 10009 | 10051 | 43 |
| a226 | 10053 | 10088 | 36 |
| a227 | 10098 | 10119 | 22 |
| a228 | 10133 | 10163 | 31 |
| a229 | 10214 | 10240 | 27 |
| a230 | 10257 | 10272 | 16 |
| a231 | 10281 | 10298 | 18 |
| a232 | 10300 | 10318 | 19 |
| a233 | 10339 | 10363 | 25 |
| a234 | 10409 | 10426 | 18 |
| a235 | 10447 | 10497 | 51 |
| a236 | 10499 | 10529 | 31 |
| a237 | 10531 | 10546 | 16 |
| a238 | 10560 | 10580 | 21 |
| a239 | 10582 | 10596 | 15 |
| a240 | 10600 | 10621 | 22 |
| a241 | 10623 | 10664 | 42 |
| a242 | 10666 | 10685 | 20 |
| a243 | 10717 | 10773 | 57 |
| a244 | 10775 | 10792 | 18 |
| a245 | 10794 | 10858 | 65 |
| a246 | 10874 | 10888 | 15 |
| a247 | 10893 | 10972 | 80 |
| a248 | 10974 | 10994 | 21 |
| a249 | 10996 | 11012 | 17 |
| a250 | 11075 | 11097 | 23 |
| a251 | 11099 | 11124 | 26 |
| a252 | 11140 | 11157 | 18 |
| a253 | 11159 | 11192 | 34 |
| a254 | 11195 | 11226 | 32 |
| a255 | 11235 | 11261 | 27 |
| a256 | 11279 | 11337 | 59 |
| a257 | 11344 | 11381 | 38 |
| a258 | 11387 | 11411 | 25 |
| a259 | 11427 | 11494 | 68 |
| a260 | 11496 | 11510 | 15 |
| a261 | 11512 | 11526 | 15 |
| a262 | 11528 | 11551 | 24 |
| a263 | 11570 | 11592 | 23 |
| a264 | 11594 | 11634 | 41 |
| a265 | 11664 | 11684 | 21 |
| a266 | 11699 | 11719 | 21 |
| a267 | 11721 | 11746 | 26 |
| a268 | 11753 | 11771 | 19 |
| a269 | 11787 | 11873 | 87 |
| a270 | 11873 | 11905 | 33 |
| a271 | 11927 | 11942 | 16 |
| a272 | 11946 | 11973 | 28 |
| a273 | 11975 | 11993 | 19 |
| a274 | 12019 | 12114 | 96 |
| a275 | 12116 | 12135 | 20 |
| a276 | 12137 | 12158 | 22 |
| a277 | 12165 | 12192 | 28 |
| a278 | 12194 | 12216 | 23 |
| a279 | 12218 | 12246 | 29 |
| a280 | 12262 | 12277 | 16 |
| a281 | 12283 | 12319 | 37 |
| a282 | 12334 | 12368 | 35 |
| a283 | 12370 | 12395 | 26 |
| a284 | 12397 | 12434 | 38 |
| a285 | 12436 | 12509 | 74 |
| a286 | 12511 | 12543 | 33 |
| a287 | 12545 | 12565 | 21 |
| a288 | 12567 | 12675 | 109 |
| a289 | 12677 | 12706 | 30 |
| a290 | 12708 | 12724 | 17 |
| a291 | 12753 | 12768 | 16 |
| a292 | 12785 | 12809 | 25 |

TABLE 4-continued

Regions of SEQ ID NO 1 which may be targeted using oligonucleotide of the invention

| Reg. a | Position in SEQ ID NO 1 | | Length |
|---|---|---|---|
| | from | to | |
| a293 | 12830 | 12859 | 30 |
| a294 | 12864 | 12885 | 22 |
| a295 | 12886 | 12916 | 31 |
| a296 | 12922 | 12946 | 25 |
| a297 | 12948 | 12970 | 23 |
| a298 | 12983 | 13003 | 21 |
| a299 | 13018 | 13051 | 34 |
| a300 | 13070 | 13090 | 21 |
| a301 | 13092 | 13115 | 24 |
| a302 | 13117 | 13134 | 18 |
| a303 | 13136 | 13169 | 34 |
| a304 | 13229 | 13249 | 21 |
| a305 | 13295 | 13328 | 34 |
| a306 | 13330 | 13372 | 43 |
| a307 | 13388 | 13406 | 19 |
| a308 | 13408 | 13426 | 19 |
| a309 | 13437 | 13453 | 17 |
| a310 | 13455 | 13471 | 17 |
| a311 | 13518 | 13547 | 30 |
| a312 | 13565 | 13597 | 33 |
| a313 | 13603 | 13620 | 18 |
| a314 | 13630 | 13663 | 34 |
| a315 | 13665 | 13679 | 15 |
| a316 | 13706 | 13725 | 20 |
| a317 | 13727 | 13774 | 48 |
| a318 | 13784 | 13821 | 38 |
| a319 | 13831 | 13878 | 48 |
| a320 | 13881 | 13940 | 60 |
| a321 | 13959 | 14013 | 55 |
| a322 | 14015 | 14031 | 17 |
| a323 | 14034 | 14049 | 16 |
| a324 | 14064 | 14114 | 51 |
| a325 | 14116 | 14226 | 111 |
| a326 | 14229 | 14276 | 48 |
| a327 | 14292 | 14306 | 15 |
| a328 | 14313 | 14384 | 72 |
| a329 | 14386 | 14408 | 23 |
| a330 | 14462 | 14481 | 20 |
| a331 | 14494 | 14519 | 26 |
| a332 | 14557 | 14577 | 21 |
| a333 | 14608 | 14628 | 21 |
| a334 | 14646 | 14668 | 23 |
| a335 | 14680 | 14767 | 88 |
| a336 | 14765 | 14779 | 15 |
| a337 | 14815 | 14844 | 30 |
| a338 | 14848 | 14925 | 78 |
| a339 | 14934 | 14976 | 43 |
| a340 | 14978 | 15009 | 32 |
| a341 | 15013 | 15057 | 45 |
| a342 | 15064 | 15091 | 28 |
| a343 | 15094 | 15140 | 47 |
| a344 | 15149 | 15165 | 17 |
| a345 | 15162 | 15182 | 21 |
| a346 | 15184 | 15198 | 15 |
| a347 | 15200 | 15221 | 22 |
| a348 | 15232 | 15247 | 16 |
| a349 | 15250 | 15271 | 22 |
| a350 | 15290 | 15334 | 45 |
| a351 | 15336 | 15369 | 34 |
| a352 | 15394 | 15416 | 23 |
| a353 | 15433 | 15451 | 19 |
| a354 | 15453 | 15491 | 39 |
| a355 | 15496 | 15511 | 16 |
| a356 | 15520 | 15553 | 34 |
| a357 | 15555 | 15626 | 72 |
| a358 | 15634 | 15652 | 19 |
| a359 | 15655 | 15688 | 34 |
| a360 | 15690 | 15735 | 46 |
| a361 | 15734 | 15764 | 31 |
| a362 | 15766 | 15787 | 22 |
| a363 | 15803 | 15819 | 17 |
| a364 | 15846 | 15899 | 54 |
| a365 | 15901 | 15934 | 34 |
| a366 | 15936 | 15962 | 27 |
| a367 | 15964 | 15985 | 22 |
| a368 | 15987 | 16023 | 37 |
| a369 | 16025 | 16061 | 37 |
| a370 | 16102 | 16122 | 21 |
| a371 | 16134 | 16183 | 50 |
| a372 | 16185 | 16281 | 97 |
| a373 | 16283 | 16298 | 16 |
| a374 | 16305 | 16323 | 19 |
| a375 | 16325 | 16356 | 32 |
| a376 | 16362 | 16404 | 43 |
| a377 | 16406 | 16456 | 51 |
| a378 | 16494 | 16523 | 30 |
| a379 | 16536 | 16562 | 27 |
| a380 | 16564 | 16580 | 17 |
| a381 | 16582 | 16637 | 56 |
| a382 | 16631 | 16649 | 19 |
| a383 | 16655 | 16701 | 47 |
| a384 | 16737 | 16781 | 45 |
| a385 | 16783 | 16804 | 22 |
| a386 | 16832 | 16907 | 76 |
| a387 | 16934 | 16965 | 32 |
| a388 | 16972 | 17035 | 64 |
| a389 | 17039 | 17069 | 31 |
| a390 | 17072 | 17109 | 38 |
| a391 | 17135 | 17150 | 16 |
| a392 | 17167 | 17209 | 43 |
| a393 | 17211 | 17242 | 32 |
| a394 | 17244 | 17299 | 56 |
| a395 | 17304 | 17344 | 41 |
| a396 | 17346 | 17400 | 55 |
| a397 | 17447 | 17466 | 20 |
| a398 | 17474 | 17539 | 66 |
| a399 | 17561 | 17604 | 44 |
| a400 | 17610 | 17663 | 54 |
| a401 | 17681 | 17763 | 83 |
| a402 | 17793 | 17810 | 18 |
| a403 | 17812 | 17852 | 41 |
| a404 | 17854 | 17928 | 75 |
| a405 | 17941 | 18005 | 65 |
| a406 | 18007 | 18035 | 29 |
| a407 | 18041 | 18077 | 37 |
| a408 | 18085 | 18146 | 62 |
| a409 | 18163 | 18177 | 15 |
| a410 | 18179 | 18207 | 29 |
| a411 | 18209 | 18228 | 20 |
| a412 | 18230 | 18266 | 37 |
| a413 | 18268 | 18285 | 18 |
| a414 | 18287 | 18351 | 65 |
| a415 | 18365 | 18395 | 31 |
| a416 | 18402 | 18432 | 31 |
| a417 | 18434 | 18456 | 23 |
| a418 | 18502 | 18530 | 29 |
| a419 | 18545 | 18590 | 46 |
| a420 | 18603 | 18621 | 19 |
| a421 | 18623 | 18645 | 23 |
| a422 | 18651 | 18708 | 58 |
| a423 | 18710 | 18729 | 20 |
| a424 | 18731 | 18758 | 28 |
| a425 | 18760 | 18788 | 29 |
| a426 | 18799 | 18859 | 61 |
| a427 | 18861 | 18926 | 66 |
| a428 | 18928 | 18980 | 53 |
| a429 | 19001 | 19018 | 18 |
| a430 | 19034 | 19054 | 21 |
| a431 | 19070 | 19092 | 23 |
| a432 | 19111 | 19154 | 44 |
| a433 | 19191 | 19213 | 23 |
| a434 | 19215 | 19240 | 26 |
| a435 | 19255 | 19356 | 102 |
| a436 | 19358 | 19446 | 89 |
| a437 | 19450 | 19468 | 19 |
| a438 | 19470 | 19512 | 43 |

TABLE 4-continued

Regions of SEQ ID NO 1 which may be targeted using oligonucleotide of the invention

| Reg. a | Position in SEQ ID NO 1 | | |
|---|---|---|---|
| | from | to | Length |
| a439 | 19514 | 19541 | 28 |
| a440 | 19543 | 19568 | 26 |
| a441 | 19570 | 19586 | 17 |
| a442 | 19588 | 19619 | 32 |
| a443 | 19683 | 19739 | 57 |
| a444 | 19741 | 19777 | 37 |
| a445 | 19779 | 19820 | 42 |
| a446 | 19822 | 19836 | 15 |
| a447 | 19838 | 19911 | 74 |
| a448 | 19913 | 19966 | 54 |
| a449 | 19968 | 20026 | 59 |

In some embodiment the oligonucleotide or contiguous nucleotide sequence is complementary to a region of the target nucleic acid, wherein the target nucleic acid region is selected from the group consisting of a7, a26, a43, a119, a142, a159, a160, a163, a169, a178, a179, a180, a189, a201, a202, a204, a214, a221, a224, a226, a243, a254, a258, 269, a274, a350, a360, a364, a365, a370, a372, a381, a383, a386, a389, a400, a427, a435 and a438.

In a preferred embodiment the oligonucleotide or contiguous nucleotide sequence is complementary to a region of the target nucleic acid, wherein the target nucleic acid region is selected from the group consisting of a160, a180, a221, a269 and a360.

In some embodiments, the oligonucleotide of the invention comprises or consists of 8 to 35 nucleotides in length, such as from 9 to 30, such as 10 to 22, such as from 11 to 20, such as from 12 to 18, such as from 13 to 17 or 14 to 16 contiguous nucleotides in length. In a preferred embodiment, the oligonucleotide comprises or consists of 16 to 20 nucleotides in length. It is to be understood that any range given herein includes the range endpoints. Accordingly, if an oligonucleotide is said to include from 10 to 30 nucleotides, both 10 and 30 nucleotides are included.

In some embodiments, the contiguous nucleotide sequence comprises or consists of 8, 9, 10, 11, 12, 13, 14, 15, 16, 17, 18, 19, 20, 21, 22, 23, 24, 25, 26, 27, 28, 29 or 30 contiguous nucleotides in length. In a preferred embodiment, the oligonucleotide comprises or consists of 16, 17, 18, 19 or 20 nucleotides in length.

In some embodiments, the oligonucleotide or contiguous nucleotide sequence comprises or consists of a sequence selected from the group consisting of sequences listed in table 5.

In some embodiments, the antisense oligonucleotide or contiguous nucleotide sequence comprises or consists of 10 to 30 nucleotides in length with at least 90% identity, preferably 100% identity, to a sequence selected from the group consisting of SEQ ID NO: 5 to 743 (see motif sequences listed in table 5).

In some embodiments, the antisense oligonucleotide or contiguous nucleotide sequence comprises or consists of 10 to 30 nucleotides in length with at least 90% identity, preferably 100% identity, to a sequence selected from the group consisting of SEQ ID NO: 5 to 743 and 771.

In some embodiments, the antisense oligonucleotide or contiguous nucleotide sequence comprises or consists of 10 to 30 nucleotides in length with at least 90% identity, preferably 100% identity, to a sequence selected from the group consisting of SEQ ID NO: 6, 8, 9, 13, 41, 42, 58, 77, 92, 111, 128, 151, 164, 166, 169, 171, 222, 233, 245, 246, 250, 251, 252, 256, 272, 273, 287, 292, 303, 314, 318, 320, 324, 336, 342, 343, 344, 345, 346, 349, 359, 360, 374, 408, 409, 415, 417, 424, 429, 430, 458, 464, 466, 474, 490, 493, 512, 519, 519, 529, 533, 534, 547, 566, 567, 578, 582, 601, 619, 620, 636, 637, 638, 640, 645, 650, 651, 652, 653, 658, 659, 660, 665, 678, 679, 680, 682, 683, 684, 687, 694, 706, 716, 728, 733, 734, and 735.

In some embodiments, the antisense oligonucleotide or contiguous nucleotide sequence comprises or consists of 10 to 30 nucleotides in length with at least 90% identity, preferably 100% identity, to SEQ ID NO: 287.

In some embodiments, the antisense oligonucleotide or contiguous nucleotide sequence comprises or consists of 10 to 30 nucleotides in length with at least 90% identity, preferably 100% identity, to SEQ ID NO: 342.

In some embodiments, the antisense oligonucleotide or contiguous nucleotide sequence comprises or consists of 10 to 30 nucleotides in length with at least 90% identity, preferably 100% identity, to SEQ ID NO: 640.

In some embodiments, the antisense oligonucleotide or contiguous nucleotide sequence comprises or consists of 10 to 30 nucleotides in length with at least 90% identity, preferably 100% identity, to SEQ ID NO: 466.

In some embodiments, the antisense oligonucleotide or contiguous nucleotide sequence comprises or consists of 10 to 30 nucleotides in length with at least 90% identity, preferably 100% identity, to SEQ ID NO: 566.

In embodiments where the oligonucleotide is longer than the contiguous nucleotide sequence (which is complementary to the target nucleic acid), the motif sequences in table 5 form the contigious nucleotide sequence part of the antisense oligonucleotides of the invention. In some embodiments the sequence of the oligonucleotide is equivalent to the contigious nucleotide sequence (e.g. if no biocleavable linkers are added).

It is understood that the contiguous nucleobase sequences (motif sequence) can be modified to for example increase nuclease resistance and/or binding affinity to the target nucleic acid. Modifications are described in the definitions and in the "Oligonucleotide design" section. Table 5 lists preferred designs of each motif sequence.

Oligonucleotide Design

Oligonucleotide design refers to the pattern of nucleoside sugar modifications in the oligonucleotide sequence. The oligonucleotides of the invention comprise sugar-modified nucleosides and may also comprise DNA or RNA nucleosides. In some embodiments, the oligonucleotide comprises sugar-modified nucleosides and DNA nucleosides. Incorporation of modified nucleosides into the oligonucleotide of the invention may enhance the affinity of the oligonucleotide for the target nucleic acid. In that case, the modified nucleosides can be referred to as affinity enhancing modified nucleotides, the modified nucleosides may also be termed units.

In an embodiment, the oligonucleotide comprises at least 1 modified nucleoside, such as at least 2, at least 3, at least 4, at least 5, at least 6, at least 7, at least 8, at least 9, at least 10, at least 11, at least 12, at least 13, at least 14, at least 15 or at least 16 modified nucleosides. In an embodiment the oligonucleotide comprises from 1 to 10 modified nucleosides, such as from 2 to 8 modified nucleosides, such as from 3 to 7 modified nucleosides, such as from 4 to 6 modified nucleosides, such as 3, 4, 5, 6 or 7 modified nucleosides.

In an embodiment, the oligonucleotide comprises one or more sugar modified nucleosides, such as 2' sugar modified nucleosides. Preferably the oligonucleotide of the invention comprise the one or more 2' sugar modified nucleoside independently selected from the group consisting of 2'-O-alkyl-RNA, 2'-O-methyl-RNA, 2'-alkoxy-RNA, 2'-O-methoxyethyl-RNA, 2'-amino-DNA, 2'-fluoro-DNA, arabino nucleic acid (ANA), 2'-fluoro-ANA and LNA nucleosides. Even more preferably the one or more modified nucleoside is a locked nucleic acid (LNA).

In a further embodiment the oligonucleotide comprises at least one modified internucleoside linkage. In a preferred embodiment all the internucleoside linkages within the contiguous nucleotide sequence are phosphorothioate or boranophosphate internucleoside linkages. In some embodiments all the internucleotide linkages in the contiguous sequence of the oligonucleotide are phosphorothioate linkages.

In some embodiments, the oligonucleotide of the invention comprises at least one LNA nucleoside, such as 1, 2, 3, 4, 5, 6, 7, or 8 LNA nucleosides, such as from 2 to 6 LNA nucleosides, such as from 3 to 7 LNA nucleosides, 4 to 6 LNA nucleosides or 3, 4, 5, 6 or 7 LNA nucleosides. In some embodiments, at least 75% of the modified nucleosides in the oligonucleotide are LNA nucleosides, such as 80%, such as 85%, such as 90% of the modified nucleosides are LNA nucleosides. In a still further embodiment all the modified nucleosides in the oligonucleotide are LNA nucleosides. In a further embodiment, the oligonucleotide may comprise both beta-D-oxy-LNA, and one or more of the following LNA nucleosides: thio-LNA, amino-LNA, oxy-LNA, and/or ENA in either the beta-D or alpha-L configurations or combinations thereof. In a further embodiment, all LNA cytosine units are 5-methyl-cytosine. In a preferred embodiment the oligonucleotide or contiguous nucleotide sequence has at least 1 LNA nucleoside at the 5' end and at least 2 LNA nucleosides at the 3' end of the nucleotide sequence.

In some embodiments, the oligonucleotide of the invention comprises at least one modified nucleoside which is a 2'-MOE-RNA nucleoside, such as 2, 3, 4, 5, 6, 7, 8, 9 or 10 2'-MOE-RNA nucleosides. In some embodiments, at least one of said modified nucleoside is 2'-fluoro DNA, such as 2, 3, 4, 5, 6, 7, 8, 9 or 10 2'-fluoro-DNA nucleosides.

In some embodiments, the oligonucleotide of the invention comprises at least one LNA nucleoside and at least one 2' substituted modified nucleoside.

In some embodiments of the invention, the oligonucleotide comprise both 2' sugar modified nucleosides and DNA units. Preferably the oligonucleotide comprises both LNA and DNA nucleosides (units). Preferably, the combined total of LNA and DNA units is 8-30, such as 10-25, preferably 12-22, such as 12-18, even more preferably 11-16. In some embodiments of the invention, the nucleotide sequence of the oligonucleotide, such as the contiguous nucleotide sequence consists of at least one or two LNA nucleosides and the remaining nucleosides are DNA units. In some embodiments the oligonucleotide comprises only LNA nucleosides and naturally occurring nucleosides (such as RNA or DNA, most preferably DNA nucleosides), optionally with modified internucleoside linkages such as phosphorothioate.

In an embodiment of the invention the oligonucleotide of the invention is capable of recruiting RNase H.

The structural design of the oligonucleotide of the invention may be selected from gapmers, gapbreakers, headmers and tailmers.

Gapmer Design

In a preferred embodiment the oligonucleotide of the invention has a gapmer design or structure also referred herein merely as "Gapmer". In a gapmer structure the oligonucleotide comprises at least three distinct structural regions a 5'-flank, a gap and a 3'-flank, F-G-F' in '5->3' orientation. In this design, flanking regions F and F' (also termed wing regions) comprise a contiguous stretch of modified nucleosides, which are complementary to the PD-L1 target nucleic acid, while the gap region, G, comprises a contiguous stretch of nucleotides which are capable of recruiting a nuclease, preferably an endonuclease such as RNase, for example RNase H, when the oligonucleotide is in duplex with the target nucleic acid. Nucleosides which are capable of recruiting a nuclease, in particular RNase H, can be selected from the group consisting of DNA, alpha-L-oxy-LNA, 2'-Flouro-ANA and UNA. Regions F and F', flanking the 5' and 3' ends of region G, preferably comprise non-nuclease recruiting nucleosides (nucleosides with a 3' endo structure), more preferably one or more affinity enhancing modified nucleosides. In some embodiments, the 3' flank comprises at least one LNA nucleoside, preferably at least 2 LNA nucleosides. In some embodiments, the 5' flank comprises at least one LNA nucleoside. In some embodiments both the 5' and 3' flanking regions comprise a LNA nucleoside. In some embodiments all the nucleosides in the flanking regions are LNA nucleosides. In other embodiments, the flanking regions may comprise both LNA nucleosides and other nucleosides (mixed flanks), such as DNA nucleosides and/or non-LNA modified nucleosides, such as 2' substituted nucleosides. In this case the gap is defined as a contiguous sequence of at least 5 RNase H recruiting nucleosides (nucleosides with a 2' endo structure, preferably DNA) flanked at the 5' and 3' end by an affinity enhancing modified nucleoside, preferably LNA, such as beta-D-oxy-LNA. Consequently, the nucleosides of the 5' flanking region and the 3' flanking region which are adjacent to the gap region are modified nucleosides, preferably non-nuclease recruiting nucleosides.

Region F

Region F (5' flank or 5' wing) attached to the '5 end of region G comprises, contains or consists of at least one modified nucleoside such as at least 2, at least 3, at least 4, at least 5, at least 6, at least 7 modified nucleosides. In an embodiment region F comprises or consists of from 1 to 7 modified nucleosides, such as from 2 to 6 modified nucleosides, such as from 2 to 5 modified nucleosides, such as from 2 to 4 modified nucleosides, such as from 1 to 3 modified nucleosides, such as 1, 2, 3 or 4 modified nucleosides. The F region is defined by having at least on modified nucleoside at the 5' end and at the 3' end of the region.

In some embodiments, the modified nucleosides in region F have a 3' endo structure.

In an embodiment, one or more of the modified nucleosides in region F are 2' modified nucleosides. In one embodiment all the nucleosides in Region F are 2' modified nucleosides.

In another embodiment region F comprises DNA and/or RNA in addition to the 2' modified nucleosides. Flanks comprising DNA and/or RNA are characterized by having a 2' modified nucleoside in the 5' end and the 3' end (adjacent to the G region) of the F region. In one embodiment the region F comprise DNA nucleosides, such as from 1 to 3 contiguous DNA nucleosides, such as 1 to 3 or 1 to 2 contiguous DNA nucleosides. The DNA nucleosides in the flanks should preferably not be able to recruit RNase H. In some embodiments the 2' modified nucleosides and DNA and/or RNA nucleosides in the F region alternate with 1 to 3 2' modified nucleosides and 1 to 3 DNA and/or RNA nucleosides. Such flanks can also be termed alternating flanks. The length of the 5' flank (region F) in oligonucleotides with alternating flanks may be 4 to 10 nucleosides, such as 4 to 8, such as 4 to 6 nucleosides, such as 4, 5, 6 or 7 modified nucleosides. In some embodiments only the 5' flank of the oligonucleotide is alternating. Specific examples of region F with alternating nucleosides are

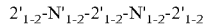

Where 2' indicates a modified nucleoside and N' is a RNA or DNA. In some embodiments all the modified nucleosides in the alternating flanks are LNA and the N' is DNA. In a further embodiment one or more of the 2' modified nucleosides in region F are selected from 2'-O-alkyl-RNA units, 2'-O-methyl-RNA, 2'-amino-DNA units, 2'-fluoro-DNA units, 2'-alkoxy-RNA, MOE units, LNA units, arabino nucleic acid (ANA) units and 2'-fluoro-ANA units.

In some embodiments the F region comprises both LNA and a 2' substituted modified nucleoside. These are often termed mixed wing or mixed flank oligonucleotides.

In one embodiment of the invention all the modified nucleosides in region F are LNA nucleosides. In a further embodiment all the nucleosides in Region F are LNA nucleosides. In a further embodiment the LNA nucleosides in region F are independently selected from the group consisting of oxy-LNA, thio-LNA, amino-LNA, cET, and/or ENA, in either the beta-D or alpha-L configurations or combinations thereof. In a preferred embodiment region F comprise at least 1 beta-D-oxy LNA unit, at the 5' end of the contiguous sequence.

Region G

Region G (gap region) preferably comprise, contain or consist of at least 4, such as at least 5, such as at least 6, at least 7, at least 8, at least 9, at least 10, at least 11, at least 12, at least 13, at least 14, at least 15 or at least 16 consecutive nucleosides capable of recruiting the aforementioned nuclease, in particular RNaseH. In a further embodiment region G comprise, contain or consist of from 5 to 12, or from 6 to 10 or from 7 to 9, such as 8 consecutive nucleotide units capable of recruiting aforementioned nuclease.

The nucleoside units in region G, which are capable of recruiting nuclease are in an embodiment selected from the group consisting of DNA, alpha-L-LNA, $C_4'$ alkylated DNA (as described in PCT/EP2009/050349 and Vester et al., Bioorg. Med. Chem. Lett. 18 (2008)2296-2300, both incorporated herein by reference), arabinose derived nucleosides like ANA and 2'F-ANA (Mangos et al. 2003 J. AM. CHEM. SOC. 125, 654-661), UNA (unlocked nucleic acid) (as described in Fluiter et al., Mol. Biosyst., 2009, 10, 1039 incorporated herein by reference). UNA is unlocked nucleic acid, typically where the bond between $C_2$ and C3 of the ribose has been removed, forming an unlocked "sugar" residue.

In a still further embodiment at least one nucleoside unit in region G is a DNA nucleoside unit, such as from 1 to 18 DNA units, such as 2, 3, 4, 5, 6, 7, 8, 9, 10, 11, 12, 13, 14, 15, 16 or 17 DNA units, preferably from 2 to 17 DNA units, such as from 3 to 16 DNA units, such as from 4 to 15 DNA units. such as from 5 to 14 DNA units, such as from 6 to 13 DNA units, such as from 7 to 12 DNA units, such as from 8 to 11 DNA units, more preferably from units 8 to 17 DNA units, or from 9 to 16 DNA units, 10 to 15 DNA units or 11 to 13 DNA units, such as 8, 9, 10, 11, 12, 13, 14, 154, 16, 17 DNA units. In some embodiments, region G consists of 100% DNA units.

In further embodiments the region G may consist of a mixture of DNA and other nucleosides capable of mediating RNase H cleavage. Region G may consist of at least 50% DNA, more preferably 60%, 70% or 80% DNA, and even more preferred 90% or 95% DNA.

In a still further embodiment at least one nucleoside unit in region G is an alpha-L-LNA nucleoside unit, such as at least one alpha-L-LNA, such as 2, 3, 4, 5, 6, 7, 8 or 9 alpha-L-LNA. In a further embodiment, region G comprises the least one alpha-L-LNA is alpha-L-oxy-LNA. In a further embodiment region G comprises a combination of DNA and alpha-L-LNA nucleoside units.

In some embodiments, nucleosides in region G have a 2' endo structure.

In some embodiments region G may comprise a gapbreaker nucleoside, leading to a gapbreaker oligonucleotide, which is capable of recruiting RNase H.

Region F'

Region F' (3' flank or 3' wing) attached to the '3 end of region G comprises, contains or consists of at least one modified nucleoside such as at least 2, at least 3, at least 4, at least 5, at least 6, at least 7 modified nucleosides. In an embodiment region F' comprise or consist of from 1 to 7 modified nucleosides, such as from 2 to 6 modified nucleoside, such as from 2 to 4 modified nucleosides, such as from 1 to 3 modified nucleosides, such as 1, 2, 3 or 4 modified nucleosides. The F' region is defined by having at least on modified nucleoside at the 5' end and at the 3' end of the region.

In some embodiments, the modified nucleosides in region F' have a 3' endo structure.

In an embodiment, one or more of the modified nucleosides in region F' are 2' modified nucleosides. In one embodiment all the nucleosides in Region F' are 2' modified nucleosides.

In an embodiment, one or more of the modified nucleosides in region F' are 2' modified nucleosides.

In one embodiment all the nucleosides in Region F' are 2' modified nucleosides. In another embodiment region F' comprises DNA or RNA in addition to the 2' modified nucleosides. Flanks comprising DNA or RNA are characterized by having a 2' modified nucleoside in the 5' end (adjacent to the G region) and the 3' end of the F' region. In one embodiment the region F' comprises DNA nucleosides, such as from 1 to 4 contiguous DNA nucleosides, such as 1 to 3 or 1 to 2 contiguous DNA nucleosides. The DNA nucleosides in the flanks should preferably not be able to recruit RNase H. In some embodiments the 2' modified nucleosides and DNA and/or RNA nucleosides in the F' region alternate with 1 to 3 2' modified nucleosides and 1 to 3 DNA and/or RNA nucleosides, such flanks can also be termed alternating flanks. The length of the 3' flank (region F') in oligonucleotides with alternating flanks may be 4 to 10 nucleosides, such as 4 to 8, such as 4 to 6 nucleosides, such as 4, 5, 6 or 7 modified nucleosides. In some embodiments only the 3' flank of the oligonucleotide is alternating. Specific examples of region F' with alternating nucleosides are

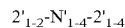

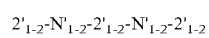

Where 2' indicates a modified nucleoside and N' is a RNA or DNA. In some embodiments all the modified nucleosides in the alternating flanks are LNA and the N' is DNA. In a further embodiment modified nucleosides in region F' are selected from 2'-O-alkyl-RNA units, 2'-O-methyl-RNA, 2'-amino-DNA units, 2'-fluoro-DNA units, 2'-alkoxy-RNA, MOE units, LNA units, arabino nucleic acid (ANA) units and 2'-fluoro-ANA units.

In some embodiments the F' region comprises both LNA and a 2' substituted modified nucleoside. These are often termed mixed wing or mixed flank oligonucleotides.

In one embodiment of the invention all the modified nucleosides in region F' are LNA nucleosides. In a further embodiment all the nucleosides in Region F' are LNA nucleosides. In a further embodiment the LNA nucleosides in region F' are independently selected from the group consisting of oxy-LNA, thio-LNA, amino-LNA, cET and/or ENA, in either the beta-D or alpha-L configurations or combinations thereof. In a preferred embodiment region F' has at least 2 beta-D-oxy LNA unit, at the 3' end of the contiguous sequence.

Region D' and D"

Region D' and D" can be attached to the 5' end of region F or the 3' end of region F', respectively. Region D' or D" are optional.

Region D' or D" may independently comprise 0 to 5, such as 1 to 5, such as 2 to 4, such as 0, 1, 2, 3, 4 or 5 additional nucleotides, which may be complementary or non-complementary to the target nucleic acid. In this respect the oligonucleotide of the invention, may in some embodiments comprise a contiguous nucleotide sequence capable of modulating the target which is flanked at the 5' and/or 3' end by additional nucleotides. Such additional nucleotides may serve as a nuclease susceptible biocleavable linker (see definition of linkers). In some embodiments the additional 5' and/or 3' end nucleosides are linked with phosphodiester linkages, and may be DNA or RNA. In another embodiment, the additional 5' and/or 3' end nucleosides are modified nucleosides which may for example be included to enhance nuclease stability or for ease of synthesis. In one embodiment, the oligonucleotide of the invention, comprises a region D' and/or D" at the 5' or 3' end of the contiguous nucleotide sequence. In a further embodiment the D' and/or D" region is composed of 1 to 5 phosphodiester linked DNA or RNA nucleosides which are not complementary to the target nucleic acid.

The gapmer oligonucleotide of the present invention can be represented by the following formulae:

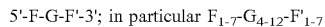
5'-F-G-F'-3'; in particular $F_{1-7}$-$G_{4-12}$-$F'_{1-7}$

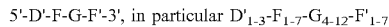
5'-D'-F-G-F'-3', in particular $D'_{1-3}$-$F_{1-7}$-$G_{4-12}$-$F'_{1-7}$

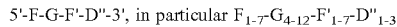
5'-F-G-F'-D"-3', in particular $F_{1-7}$-$G_{4-12}$-$F'_{1-7}$-$D''_{1-3}$

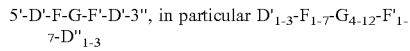
5'-D'-F-G-F'-D"-3', in particular $D'_{1-3}$-$F_{1-7}$-$G_{4-12}$-$F'_{1-7}$-$D''_{1-3}$ The preferred number and types of nucleosides in regions F, G and F', D' and D" have been described above. The oligonucleotide conjugates of the present invention have a region C covalently attached to either the 5' or 3' end of the oligonucleotide, in particular the gapmer oligonucleotides presented above.

In one embodiment the oligonucleotide conjugate of the invention comprises a oligonucleotide with the formula 5'-D'-F-G-F'-3' or 5'-F-G-F'-D"-3', where region F and F' independently comprise 1-7 modified nucleosides, G is a region between 6 and 16 nucleosides which are capable of recruiting RNaseH and region D' or D" comprise 1-5 phosphodiester linked nucleosides. Preferably region D' or D" is present in the end of the oligonucleotide where conjugation to a conjugate moiety is contemplated.

Examples of oligonucleotides with alternating flanks can be represented by the following formulae:

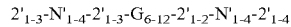
$2'_{1-3}$-$N'_{1-4}$-$2'_{1-3}$-$G_{6-12}$-$2'_{1-2}$-$N'_{1-4}$-$2'_{1-4}$

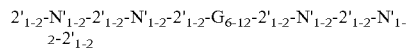
$2'_{1-2}$-$N'_{1-2}$-$2'_{1-2}$-$N'_{1-2}$-$2'_{1-2}$-$G_{6-12}$-$2'_{1-2}$-$N'_{1-2}$-$2'_{1-2}$-$N'_{1-2}$-$2'_{1-2}$

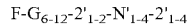
F-$G_{6-12}$-$2'_{1-2}$-$N'_{1-4}$-$2'_{1-4}$

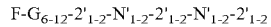
F-$G_{6-12}$-$2'_{1-2}$-$N'_{1-2}$-$2'_{1-2}$-$N'_{1-2}$-$2'_{1-2}$

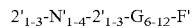
$2'_{1-3}$-$N'_{1-4}$-$2'_{1-3}$-$G_{6-12}$-F'

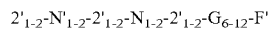
$2'_{1-2}$-$N'_{1-2}$-$2'_{1-2}$-$N_{1-2}$-$2'_{1-2}$-$G_{6-12}$-F'

Where a flank is indicated by F or F' it only contains 2' modified nucleosides, such as LNA nucleosides. The preferred number and types of nucleosides in the alternating regions, and region F, G and F', D' and D" have been described above.

In some embodiments the oligonucleotide is a gapmer consisting of 16, 17, 18, 19, 20, 21, 22 nucleotides in length, wherein each of regions F and F' independently consists of 1, 2, 3 or 4 modified nucleoside units complementary to the PD-L1 target nucleic acid and region G consists of 8, 9, 10, 11, 12, 13, 14, 15, 16, 17 nucleoside units, capable of recruiting nuclease when in duplex with the PD-L1 target nucleic acid and region D' consists of 2 phosphodiester linked DNAs.

In a further embodiments, the oligonucleotide is a gapmer wherein each of regions F and F' independently consists of 3, 4, 5 or 6 modified nucleoside units, such as nucleoside units containing a 2'-O-methoxyethyl-ribose sugar (2'-MOE) or nucleoside units containing a 2'-fluoro-deoxyribose sugar and/or LNA units, and region G consists of 8, 9, 10, 11, 12, 13, 14, 15, 16 or 17 nucleoside units, such as DNA units or other nuclease recruiting nucleosides such as alpha-L-LNA or a mixture of DNA and nuclease recruiting nucleosides.

In a further specific embodiment, the oligonucleotide is a gapmer wherein each of regions F and F' region consists of two LNA units each, and region G consists of 12, 13, 14 nucleoside units, preferably DNA units. Specific gapmer designs of this nature include 2-12-2, 2-13-2 and 2-14-2.

In a further specific embodiment, the oligonucleotide is a gapmer wherein each of regions F and F' independently consists of three LNA units, and region G consists of 8, 9, 10, 11, 12, 13 or 14 nucleoside units, preferably DNA units. Specific gapmer designs of this nature include 3-8-3, 3-9-3 3-10-3, 3-11-3, 3-12-3, 3-13-3 and 3-14-3.

In a further specific embodiment, the oligonucleotide is a gapmer wherein each of regions F and F' consists of four LNA units each, and region G consists of 8 or 9, 10, 11 or 12 nucleoside units, preferably DNA units. Specific gapmer designs of this nature include 4-8-4, 4-9-4, 4-10-4, 4-11-4 and 4-12-4.

Specific gapmer designs of this nature include F-G-F' designs selected from a group consisting of a gap with 6 nucleosides and independently 1 to 4 modified nucleosides in the wings including 1-6-1, 1-6-2, 2-6-1, 1-6-3, 3-6-1, 1-6-4, 4-6-1, 2-6-2, 2-6-3, 3-6-2 2-6-4, 4-6-2, 3-6-3, 3-6-4 and 4-6-3 gapmers.

Specific gapmer designs of this nature include F-G-F' designs selected from a group consisting of a gap with 7 nucleosides and independently 1 to 4 modified nucleosides in the wings including 1-7-1, 2-7-1, 1-7-2, 1-7-3, 3-7-1, 1-7-4, 4-7-1, 2-7-2, 2-7-3, 3-7-2, 2-7-4, 4-7-2, 3-7-3, 3-7-4, 4-7-3 and 4-7-4 gapmers.

Specific gapmer designs of this nature include F-G-F' designs selected from a group consisting of a gap with 8 nucleosides and independently 1 to 4 modified nucleosides in the wings including 1-8-1, 1-8-2, 1-8-3, 3-8-1, 1-8-4, 4-8-1, 2-8-1, 2-8-2, 2-8-3, 3-8-2, 2-8-4, 4-8-2, 3-8-3, 3-8-4, 4-8-3 and 4-8-4 gapmers.

Specific gapmer designs of this nature include F-G-F' designs selected from a group consisting of a gap with 9 nucleosides and independently 1 to 4 modified nucleosides in the wings including, 1-9-1, 2-9-1, 1-9-2, 1-9-3, 3-9-1, 1-9-4, 4-9-1, 2-9-2, 2-9-3, 3-9-2, 2-9-4, 4- 9-2, 3-9-3, 3-9-4, 4-9-3 and 4-9-4 gapmers.

Specific gapmer designs of this nature include F-G-F' designs selected from a group consisting of a gap with 10 nucleosides including, 1-10-1, 2-10-1, 1-10-2, 1-10-3, 3-10-1, 1-10-4, 4-10-1, 2-10-2, 2-10-3, 3-10-2, 2-10-4, 4-10-2, 3-10-3, 3-10-4, 4-10-3 and 4-10-4 gapmers.

Specific gapmer designs of this nature include F-G-F' designs selected from a group consisting of a gap with 11 nucleosides including, 1-11-1, 2-11-1, 1-11-2, 1-11-3, 3-11-1, 1-11-4, 4-11-1, 2-11-2, 2-11-3, 3-11-2, 2-11-4, 4-11-2, 3-11-3, 3-11-4, 4-11-3 and 4-11-4 gapmers.

Specific gapmer designs of this nature include F-G-F' designs selected from a group consisting of a gap with 12 nucleosides including, 1-12-1, 2-12-1, 1-12-2, 1-12-3, 3-12-1, 1-12-4, 4-12-1, 2-12-2, 2-12-3, 3-12-2, 2-12-4, 4-12-2, 3-12-3, 3-12-4, 4-12-3 and 4-12-4 gapmers.

Specific gapmer designs of this nature include F-G-F' designs selected from a group consisting of a gap with 13 nucleosides including, 1-13-1, 2-13-1, 1-13-2, 1-13-3, 3-13-1, 1-13-4, 4-13-1, 2-13-2, 2-13-3, 3-13-2, 2-13-4, 4-13-2, 3-13-3, 3-13-4, 4-13-3 and 4-13-4 gapmers.

Specific gapmer designs of this nature include F-G-F' designs selected from a group consisting of a gap with 14 nucleosides including, 1-14-1, 2-14-1, 1-14-2, 1-14-3, 3-14-1, 1-14-4, 4-14-1, 2-14-2, 2-14-3, 3-14-2, 2-14-4, 4-14-2, 3-14-3, 3-14-4, 4-14-3 and 4-14-4 gapmers.

Specific gapmer designs of this nature include F-G-F' designs selected from a group consisting of a gap with 15 nucleosides including, 1-15-1, 2-15-1, 1-15-2, 1-15-3, 3-15-1, 1-15-4, 4-15-1, 2-15-2, 2-15-3, 3-15-2, 2-15-4, 4-15-2 and 3-15-3 gapmers.

Specific gapmer designs of this nature include F-G-F' designs selected from a group consisting of a gap with 16 nucleosides including, 1-16-1, 2-16-1, 1-16-2, 1-16-3, 3-16-1, 1-16-4, 4-16-1, 2-16-2, 2-16-3, 3-16-2, 2-16-4, 4-16-2 and 3-16-3 gapmers.

Specific gapmer designs of this nature include F-G-F' designs selected from a group consisting of a gap with 17 nucleosides including, 1-17-1, 2-17-1, 1-17-2, 1-17-3, 3-17-1, 1-17-4, 4-17-1, 2-17-2, 2-17-3 and 3-17-2 gapmers.

In all instances the F-G-F' design may further include region D' and/or D", which may have 1, 2 or 3 nucleoside units, such as DNA units, such as 2 phosphodiester linked DNA units. Preferably, the nucleosides in region F and F' are modified nucleosides, while nucleotides in region G are preferably unmodified nucleosides.

In each design, the preferred modified nucleoside is LNA.

In another embodiment all the internucleoside linkages in the gap in a gapmer are phosphorothioate and/or boranophosphate linkages. In another embodiment all the internucleoside linkages in the flanks (F and F' region) in a gapmer are phosphorothioate and/or boranophosphate linkages. In another preferred embodiment all the internucleoside linkages in the D' and D" region in a gapmer are phosphodiester linkages.

For specific gapmers as disclosed herein, when the cytosine (C) residues are annotated as 5-methyl-cytosine, in various embodiments, one or more of the Cs present in the oligonucleotide may be unmodified C residues.

In a particular embodiment, the gapmer is a so-called shortmer as described in WO2008/113832 incorporated herein by reference.

Further gapmer designs are disclosed in WO2004/046160, WO2007/146511 and incorporated by reference.

For certain embodiments of the invention, the oligonucleotide is selected from the group of oligonucleotide compounds with CMP-ID-NO: 5_1 to 743_1 and 771_1.

For certain embodiments of the invention, the oligonucleotide is selected from the group of oligonucleotide compounds with CMP-ID-NO 6_1, 8_1, 9_1, 13_1, 41_1, 42_1, 58_1, 77_1, 92_1, 111_1, 128_1, 151_1, 164_1, 166_1, 169_1, 171_1, 222_1, 233_1, 245_1, 246_1, 250_1, 251_1, 252_1, 256_1, 272_1, 273_1, 287_1, 292_1, 303_1, 314_1, 318_1, 320_1, 324_1, 336_1, 342_1, 343_1, 344_1, 345_1, 346_1, 349_1, 359_1, 360_1, 374_1, 408_1, 409_1, 415_1, 417_1, 424_1, 429_1, 430_1, 458_1, 464_1, 466_1, 474_1, 490_1, 493_1, 512_1, 519_1, 519_1, 529_1, 533_1, 534_1, 547_1, 566_1, 567_1, 578_1, 582_1, 601_1, 619_1, 620_1, 636_1, 637_1, 638_1, 640_1, 645_1, 650_1, 651_1, 652_1, 653_1, 658_1, 659_1, 660_1, 665_1, 678_1, 679_1, 680_1, 682_1, 683_1, 684_1, 687_1, 694_1, 706_1, 716_1, 728_1, 733_1, 734_1, and 735_1.

In one preferred embodiment of the invention, the oligonucleotide is CMP-ID-NO: 287_1.

In another preferred embodiment of the invention, the oligonucleotide is CMP-ID-NO: 342_1.

In another preferred embodiment of the invention, the oligonucleotide is CMP-ID-NO: 640_1.

In another preferred embodiment of the invention, the oligonucleotide is CMP-ID-NO: 466_1.

In another preferred embodiment of the invention, the oligonucleotide is CMP-ID-NO: 566_1.

In a further embodiment of the invention the contiguous nucleotide sequence of the oligonucleotide motifs and oligonucleotide compounds of the invention comprise two to four additional phosphodiester linked nucleosides at the 5' end of the contiguous nucleotide sequence (e.g. region D'). In one embodiment the nucleosides serve as a biocleavable linker (see sectionon biocleavable linkers). In a preferred embodiment a ca (cytidine-adenosine) dinucleotide is linked to the 5' end of contiguous nucleotide sequence (i.e. any one of the motif sequences or oligonucleotide compounds listed in table 5) via a phosphodiester linkage. In a preferred embodiuent the ca di nucleotide is not complementary to the target sequence at the position where the reminder of the contigious nucleotide is complementary.

In some embodiments of the invention the oligonucleotide or contiguous nucleotide sequence is selected from the group consisting of the nucleotide motif sequences with SEQ ID NO: 766, 767, 768, 769 and 770.

In some embodiments of the invention the oligonucleotide is selected from the group consisting of the oligonucleotide compounds with CMP-ID-NO 766_1, 767_1, 768_1, 769_1 and 770_1.

Carbohydrate Conjugate Moieties

Carbohydrate conjugate moieties include but are not limited to galactose, lactose, n-acetylgalactosamine, mannose and mannose-6-phosphate. Carbohydrate conjugates may be used to enhance delivery or activity in a range of tissues, such as liver and/or muscle. See, for example, EP1495769, WO99/65925, Yang et al., Bioconjug Chem (2009) 20 (2): 213-21. Zatsepin & Oretskaya Chem Biodivers. (2004) 1 (10): 1401-17.

In some embodiments the carbohydrate conjugate moiety is multivalent, such as, for example 2, 3 or 4 identical or non-identical carbohydrate moieties may be covalently joined to the oligonucleotide, optionally via a linker or linkers. In some embodiments the invention provides a conjugate comprising the oligonucleotide of the invention and a carbohydrate conjugate moiety.

In some embodiments, the conjugate moiety is or may comprise mannose or mannose-6-phosphate. This is particular useful for targeting muscle cells, see for example US 2012/122801.

Conjugate moieties capable of binding to the asialoglycoprotein receptor (ASGPr) are particular useful for targeting hepatocytes in liver. In some embodiments the invention provides a oligonucleotide conjugate comprising the oligonucleotide of the invention and an asialoglycoprotein receptor targeting conjugate moiety. The asialoglycoprotein receptor targeting conjugate moiety comprises one or more carbohydrate moieties capable of binding to the asialoglycoprotein receptor (ASPGr binding carbohydrate moieties) with affinity equal to or greater than that of galactose. The affinities of numerous galactose derivatives for the asialoglycoprotein receptor have been studied (see for example: Jobst, S. T. and Drickamer, K. JB. C. 1996, 271, 6686) or are readily determined using methods typical in the art.

One aspect of the present invention is an antisense oligonucleotide conjugate comprising a) an oligonucleotide (Region A) comprising a contiguous nucleotide sequence of 10 to 30 nucleotides in length with at least 90% complementarity to a PD-L1 target nucleic acid; and b) at least one asialoglycoprotein receptor targeting conjugate moiety (Region C) covalently attached to the oligonucleotide in a). The oligonucleotide or a contiguous nucleotide sequence can be as described in any of the sections "oligonucleotides of the invention", "oligonucleotide design and "gapmer design".

In some embodiments asialoglycoprotein receptor targeting conjugate moiety comprises at least one ASPGr binding carbohydrate moiety selected from the group consisting of galactose, galactosamine, N-formyl-galactosamine, N-acetylgalactosamine, N-propionyl-galactosamine, N-n-butanoyl-galactosamine and N-isobutanoylgalactosamine. In some embodiments, the asialoglycoprotein receptor targeting conjugate moiety is mono-valent, di-valent, tri-valent or tetra-valent (i.e. containing 1, 2, 3 or 4 terminal carbohydrate moieties capable of binding to the asialoglycoprotein receptor). Preferably, the asialoglycoprotein receptor targeting conjugate moiety is di-valent, even more preferred it is trivalent. In a preferred embodiment the asialoglycoprotein receptor targeting conjugate moiety comprises 1 to 3 N-acetylgalactosamine (GalNAc) moieties (also termed a GalNAc conjugate). In some embodiments the oligonucleotide conjugate comprises a asialoglycoprotein receptor targeting conjugate moiety that is a tri-valent N-acetylgalactosamine (GalNAc) moiety. GalNAc conjugates have been used with phosphodiester, methylphosphonate and PNA antisense oligonucleotides (e.g. U.S. Pat. No. 5,994,517 and Hangeland et al., Bioconjug Chem. 1995 November-December; 6 (6): 695-701, Biessen et al 1999 Biochem J. 340, 783-792 and Maier et al 2003 Bioconjug Chem 14, 18-29) and siRNAs (e.g. WO 2009/126933, WO 2012/089352 & WO 2012/083046) and with LNA and 2'-MOE modified nucleosides WO 2014/076196 WO 2014/207232 and WO 2014/179620 (hereby incorporated by reference).

To generate the asialoglycoprotein receptor targeting conjugate moiety the ASPGr binding carbohydrate moieties (preferably GalNAc) are attached to a brancher molecule through the C—I carbons of the saccharides. The ASPGr binding carbohydrate moieties are preferably linked to the brancher molecule via spacers. A preferred spacer is a flexible hydrophilic spacer (U.S. Pat. No. 5,885,968; Biessen et al. J. Med. Chern. 1995 Vol. 39 p. 1538-1546). A preferred flexible hydrophilic spacer is a PEG spacer. A preferred PEG spacer is a PEG3 spacer (three ethylene units). The brancher molecule can be any small molecule which permits attachment of two or three terminal ASPGr binding carbohydrate moieties and further permits attachment of the branch point to the oligonucleotide. An exemplary brancher molecule is a di-lysine. A di-lysine molecule contains three amine groups through which three ASPGr binding carbohydrate moieties may be attached and a carboxyl reactive group through which the di-lysine may be attached to the oligonucleotide. Alternative brancher molecules may be a doubler or trebler such as those supplied by Glen Research. In some embodiments the brancher may be selected from the from the group consisting of 1,3-bis-[5-(4,4'-dimethoxytrityloxy) pentylamido]propyl-2-[(2-cyanoethyl)-(N,N-diisopropyl)] phosphoramidite (Glen Research Catalogue Number: 10-1920-xx), tris-2,2,2-[3-(4,4'-dimethoxytrityloxy) propyloxymethyl]ethyl-[(2-cyanoethyl)-(N, N-diisopropyl)]-phosphoramidite (Glen Research Catalogue Number: 10-1922-xx), tris-2,2,2-[3-(4,4'-dimethoxytrityloxy) propyloxymethyl]methyleneoxypropyl-[(2-cyanoethyl)-(N,N-diisopropyl)]-phosphoramidite and 1-[5-(4,4'-dimethoxy-trityloxy) pentylamido]-3-[5-fluorenomethoxycarbonyl-oxy-pentylamido]-propyl-2-[(2-cyanoethyl)-(N, N-diisopropyl)]-phosphoramidite (Glen Research Catalogue Number: 10-1925-xx). WO 2014/179620 and PCT application No. PCT/EP2015/073331 describes the generation of various GalNAc conjugate moieties (hereby incorporated by reference). One or more linkers may be inserted between the brancher molecule and the oligonucleotide. In a preferred embodiment the linker is a biocleavable linker. The linker may be selected from the linkers described in the section "Linkers" and its subsections.

The asialoglycoprotein receptor targeting conjugate moiety, in particular the GalNAc conjugate moiety, may be attached to the 3'- or 5'-end of the oligonucleotide using methods known in the art. In preferred embodiments the asialoglycoprotein receptor targeting conjugate moiety is linked to the 5'-end of the oligonucleotide.

Pharmacokinetic modulators in relation to siRNAs delivery has been described in WO 2012/083046 (hereby incorporated by reference). In some embodiments the carbohydrate conjugate moiety comprises a pharmacokinetic modulator selected from the group consisting of a hydrophobic group having 16 or more carbon atoms, hydrophobic group having 16-20 carbon atoms, palmitoyl, hexadec-8-enoyl, oleyl, (9E,12E)-octadeca-9,12dienoyl, dioctanoyl, and C16-C20 acyl, and cholesterol. In a preferred embodiment the pharmacokinetic modulator containing carbohydrate conjugate moiety is a GalNAc conjugate.

Figure 3:
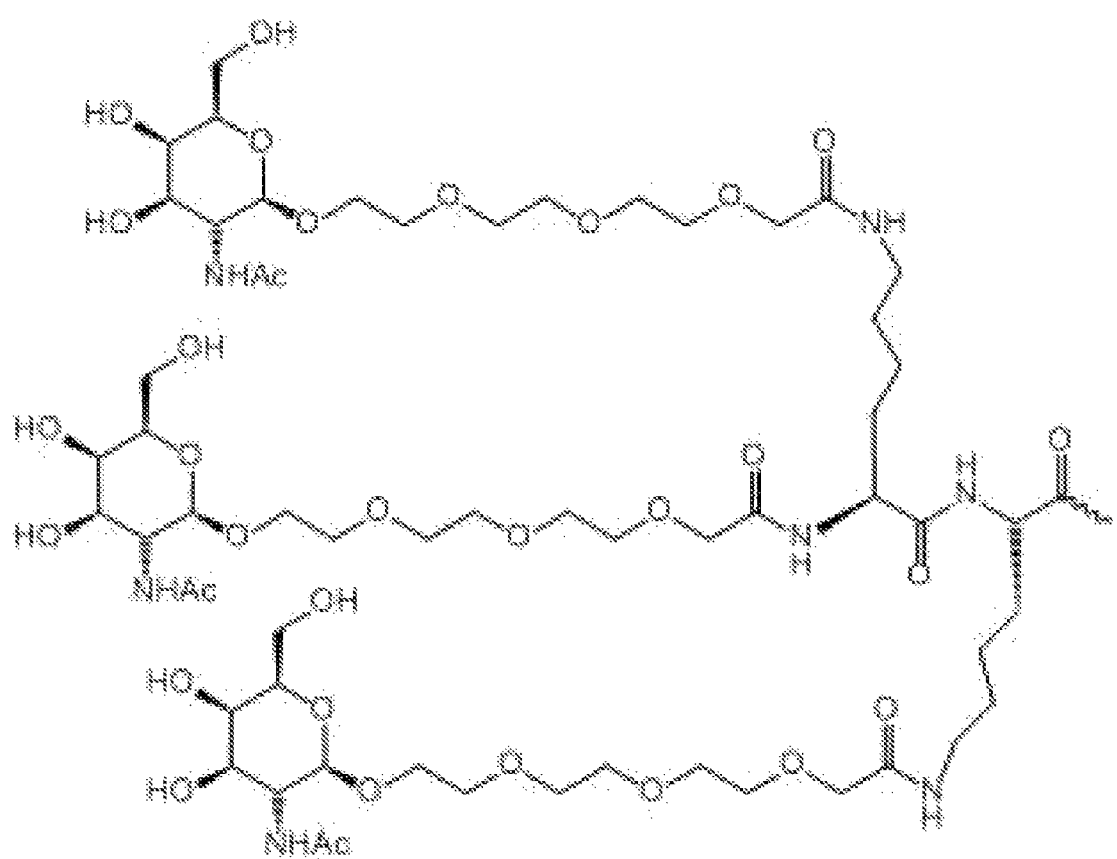
FIG. 3: Structural formula of the trivalent GalNAc cluster (GN2). GN2 is useful as conjugation moiety in the present invention. The wavy line illustrates the site of conjugation of the cluster to e.g. a C6 amino linker or directly to the oligonucleotide.

Preferred carbohydrate conjugate moieties comprises one to three terminal ASPGr binding carbohydrate moieties, preferably N-acetylgalactosamine moiety(s). In some embodiments the carbohydrate conjugate moiety comprises three ASPGr binding carbohydrate moieties, preferably N-acetylgalactosamine moieties, linked via a spacer to a brancher molecule. The spacer molecule can be between 8 and 30 atoms long. A preferred carbohydrate conjugate moiety comprises three terminal GalNAc moieties linked via a PEG spacer to a di-lysine brancher molecule. Preferably the PEG spacer is a 3PEG spacer. Suitable asialoglycoprotein receptor targeting conjugate moieties are shown in FIG. 1. A preferred asialoglycoprotein receptor targeting conjugate moiety is shown in FIG. 3.

Other GalNAc conjugate moieties can include, for example, small peptides with GalNAc moieties attached such as Tyr-Glu-Glu-(aminohexyl GalNAc)3 (YEE (ahGalNAc)3; a glycotripeptide that binds to asialoglycoprotein receptor on hepatocytes, see, e.g., Duff, et al., Methods Enzymol, 2000, 313, 297); lysine-based galactose clusters (e.g., L3G4; Biessen, et al., Cardovasc. Med., 1999, 214); and cholane-based galactose clusters (e.g., carbohydrate recognition motif for asialoglycoprotein receptor).

In some embodiments of the invention the antisense oligonucleotide conjugate is selected from the group consisting of the following CPM ID NO: 766_2, 767_2, 768_2, 769_2 and 770_2.

Figure 4:
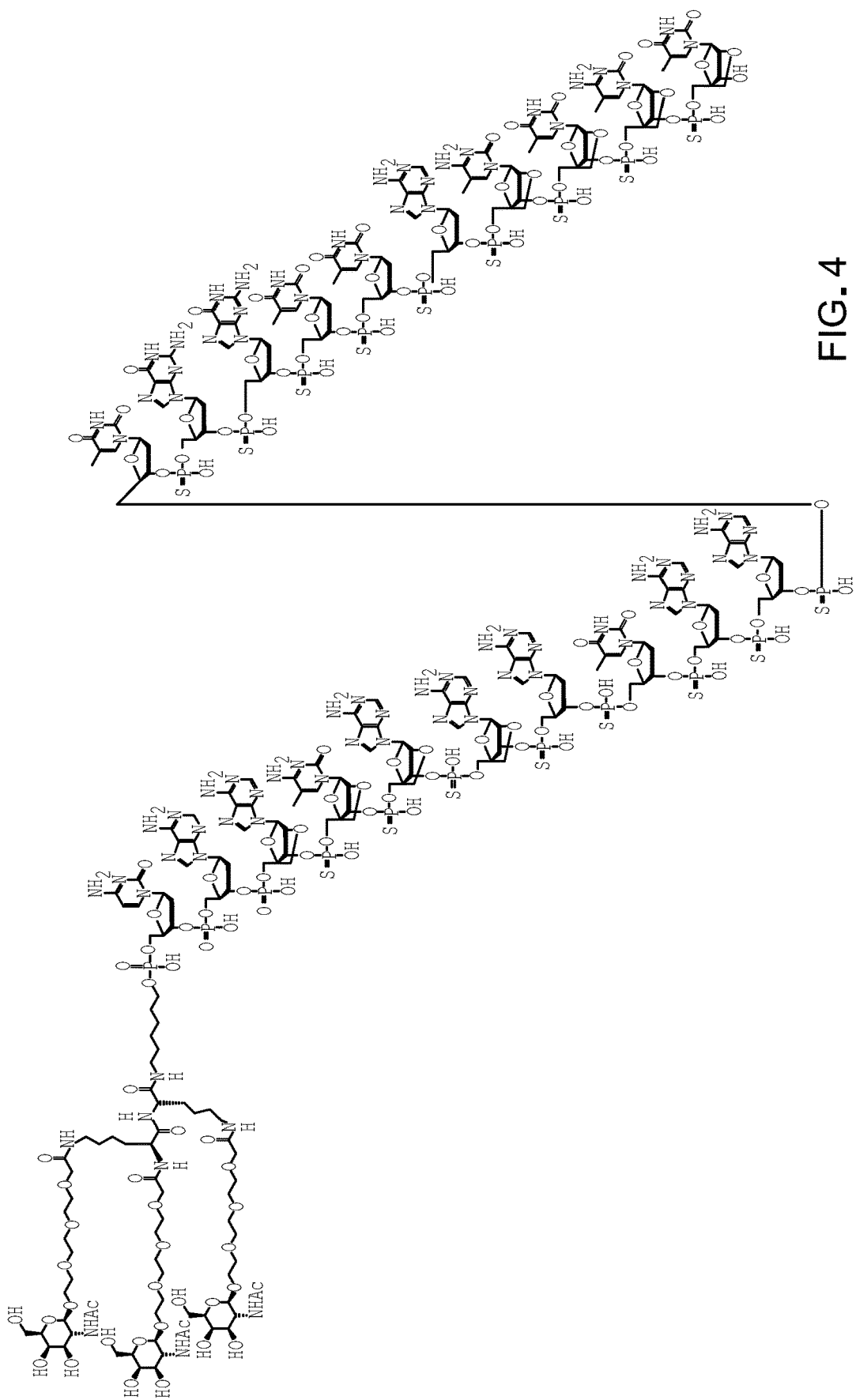
FIG. 4: Structural formula of CMP ID NO 766_2.

In a preferred embodiment the antisense oligonucleotide conjugate corresponds to the compound represented in FIG. 4.

Figure 5:
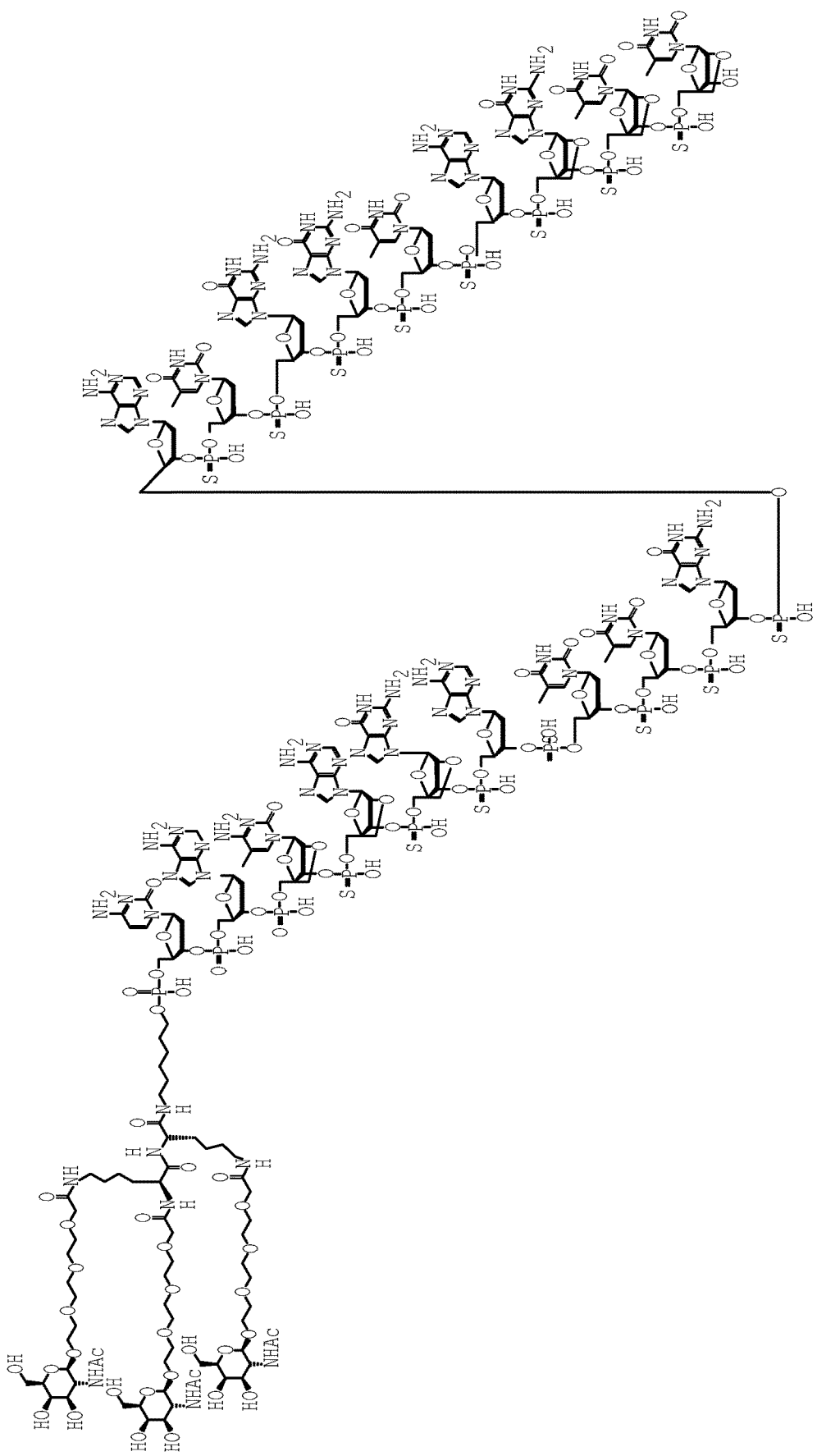
FIG. 5: Structural formula of CMP ID NO 767_2.

In another preferred embodiment the antisense oligonucleotide conjugate corresponds to the compound represented in FIG. 5.

Figure 6:
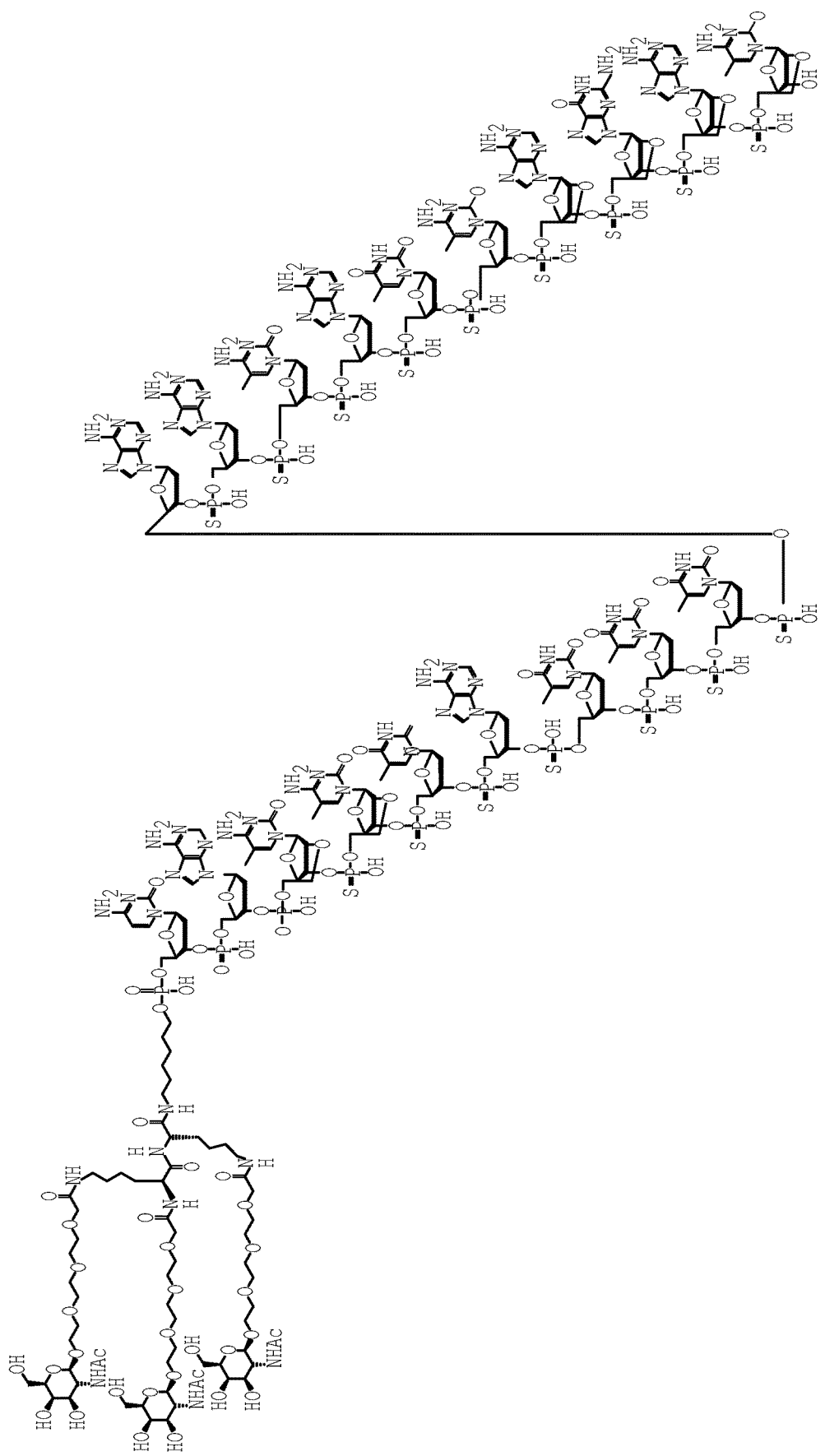
FIG. 6: Structural formula of CMP ID NO 768_2.

In another preferred embodiment the antisense oligonucleotide conjugate corresponds to the compound represented in FIG. 6.

Figure 7:
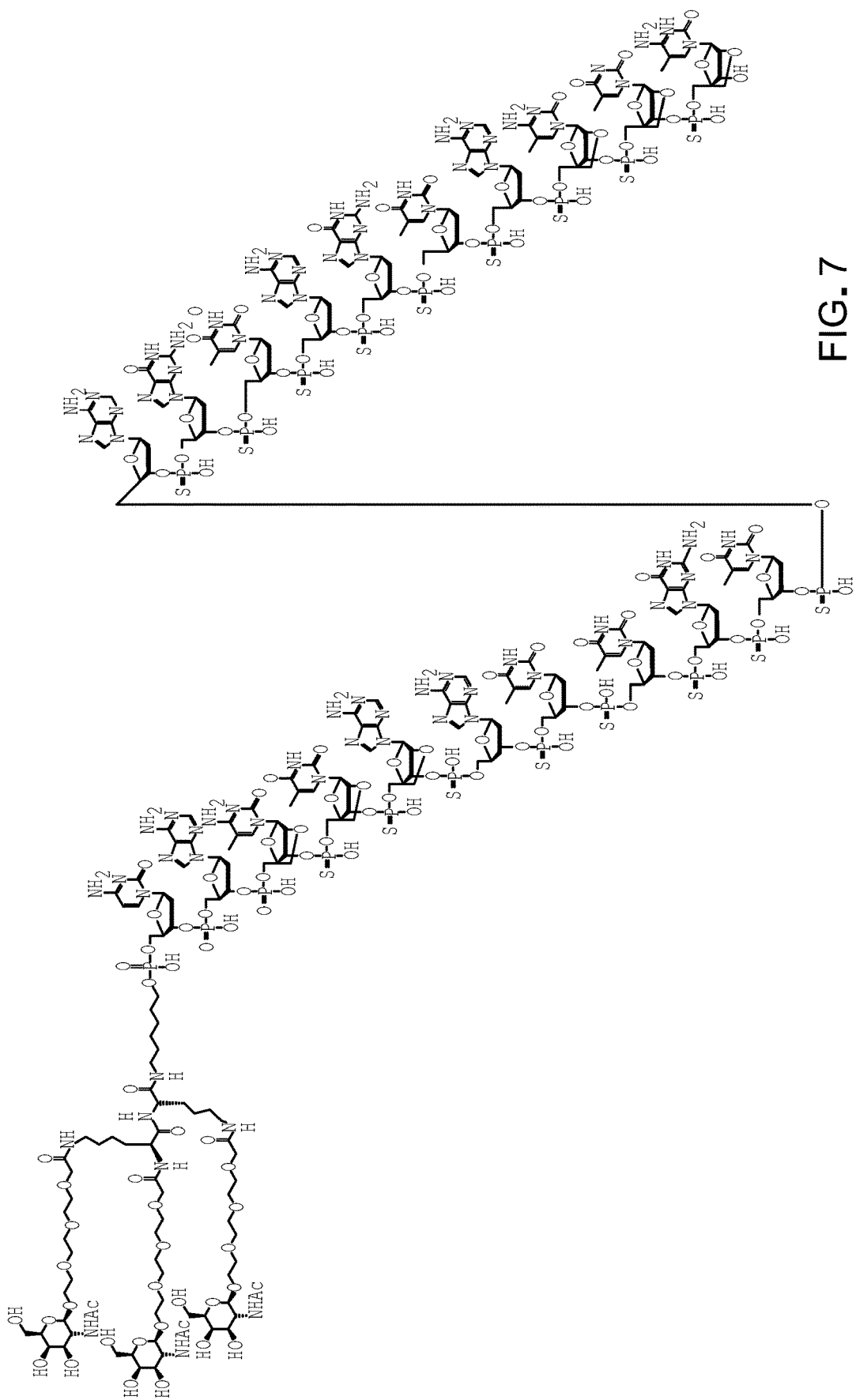
FIG. 7: Structural formula of CMP ID NO 769_2.

In another preferred embodiment the antisense oligonucleotide conjugate corresponds to the compound represented in FIG. 7.

Figure 8:
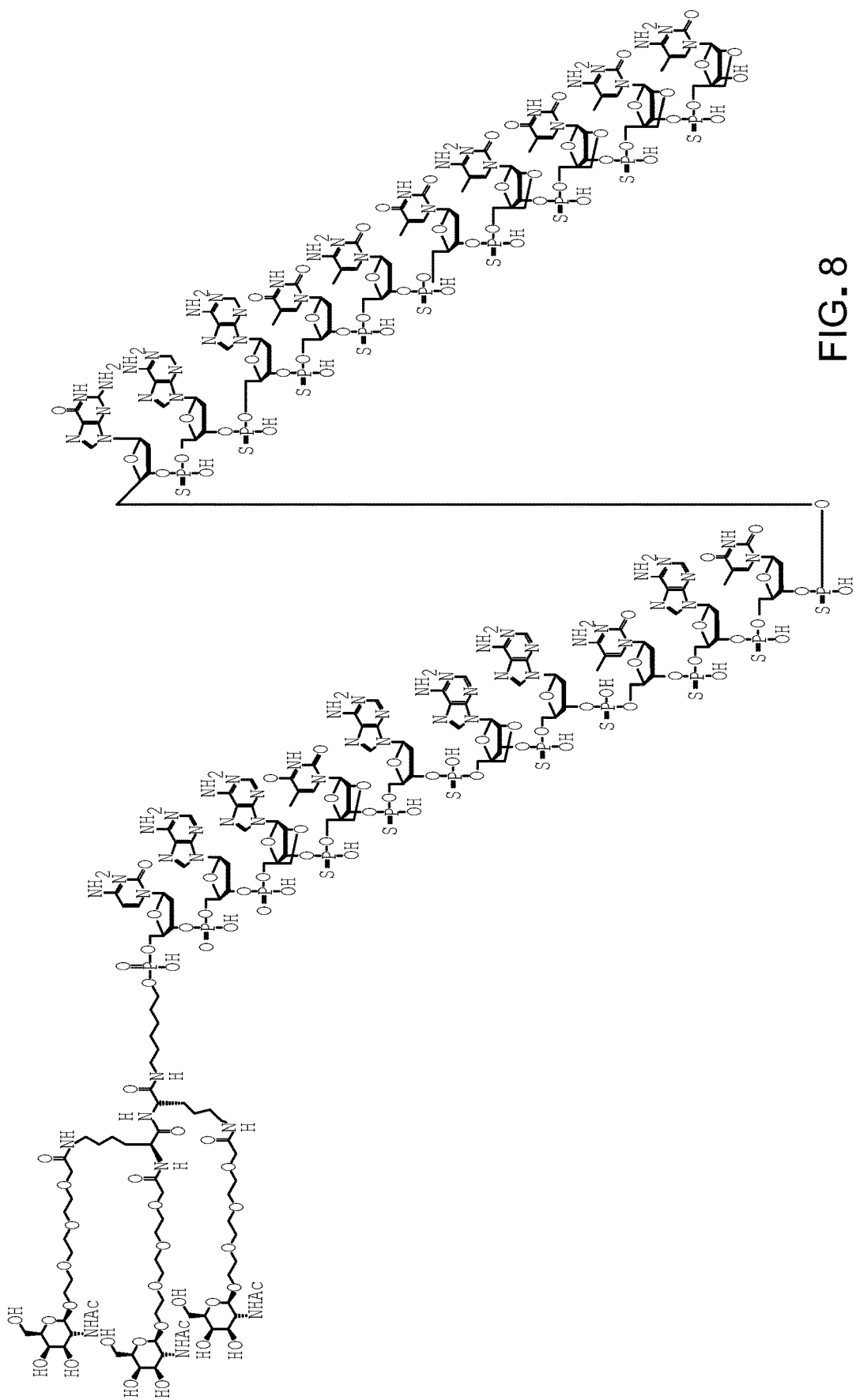
FIG. 8: Structural formula of CMP ID NO 770_2.
Figure 9:
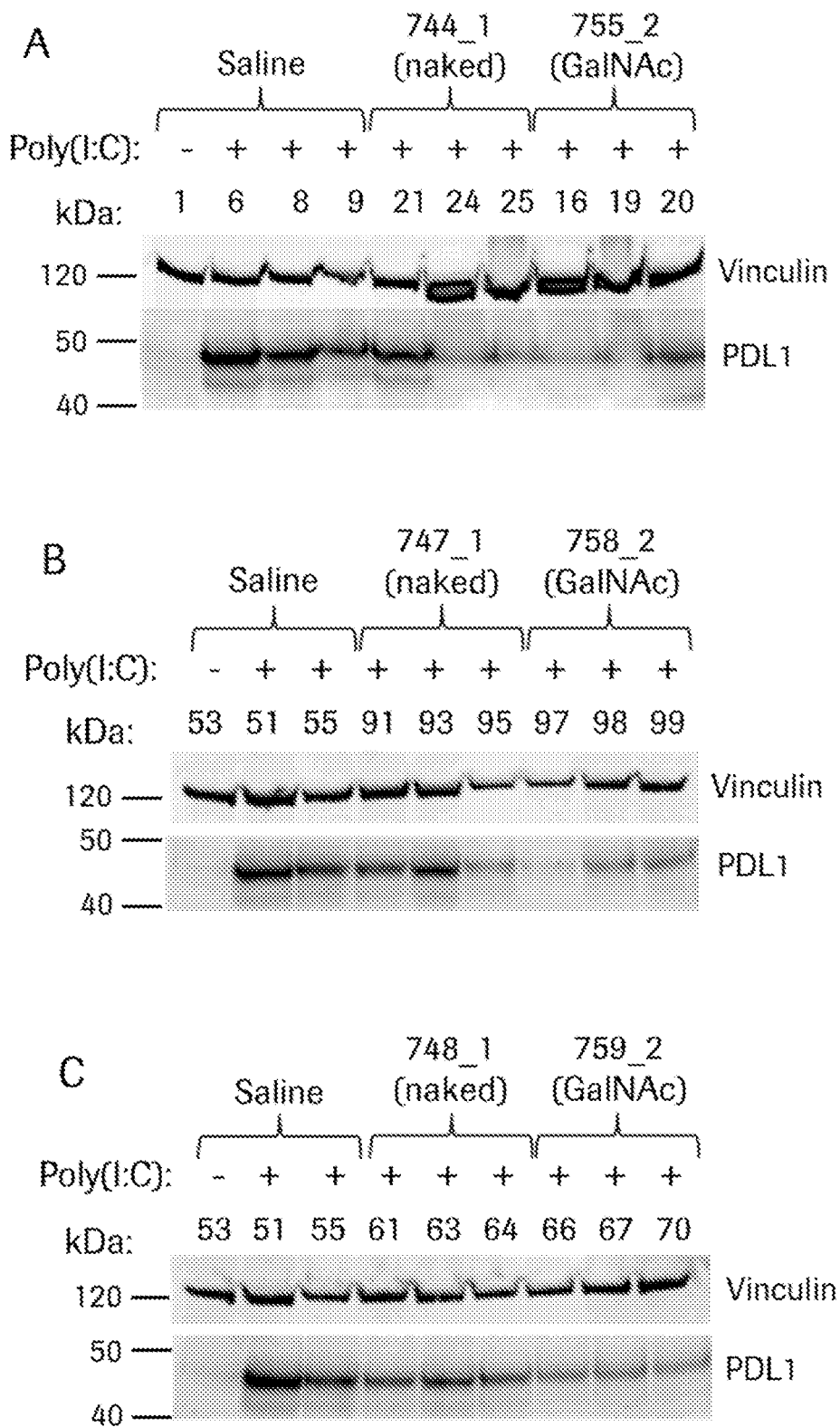
FIG. 9: Western blot detecting PD-L1 protein expression in liver from poly (IC) induced animals following treatment with saline and the indicated CMP ID NO's. Each blot shows a naked oligonucleotide versus a GalNAc conjugated version of the same oligonucleotide, blot A) CMP ID NO 744_1 and 755_2, B) CMP ID NO 747_1 and 758_2, C) CMP ID NO 748_1 and 759_2, D) CMP ID NO 752_1 and 763_2 and E) CMP ID NO 753_1 and 764_2. The upper band is the vinculin loading control, the lower band is the PD-L1 protein. The first lane in each blot show saline treated mice without Poly(IC) induction. These mice express very little PD-L protein.

In another preferred embodiment the antisense oligonucleotide conjugate corresponds to the compound represented in FIG. 8.

Linkers
Biocleavable Linkers (Region B)

The use of a conjugate is often associated with enhanced pharmacokinetic or pharmeodynamic dynamic properties. However, the presence of a conjugate moiety may interfere with the activity of the oligonucleotide against its intended target, for example via steric hindrance preventing hybridization or nuclease recruitment (e.g. RNAseH). The use of a physiologically labile bond (biocleavable linker) between the oligonucleotide (region A or first region) and the conjugate moiety (region C or third region), allows for the improved properties due to the presence of the conjugate moiety, whilst ensuring that once at the target tissue, the conjugate group does not prevent effective activity of the oligonucleotide.

Cleavage of the physiologically labile bond occurs spontaneously when a molecule containing the labile bond reaches an appropriate intra- and/or extra-cellular environment. For example, a pH labile bond may be cleaved when the molecule enters an acidified endosome. Thus, a pH labile bond may be considered to be an endosomal cleavable bond. Enzyme cleavable bonds may be cleaved when exposed to enzymes such as those present in an endosome or lysosome or in the cytoplasm. A disulfide bond may be cleaved when the molecule enters the more reducing environment of the cell cytoplasm. Thus, a disulfide may be considered to be a cytoplasmic cleavable bond. As used herein, a pH-labile bond is a labile bond that is selectively broken under acidic conditions (pH<7). Such bonds may also be termed endosomally labile bonds, since cell endosomes and lysosomes have a pH less than 7.

For biocleavable linkers associated with a conjugate moiety for targeted delivery it is preferred that, the cleavage rate seen in the target tissue (for example muscle, liver, kidney or a tumor) is greater than that found in blood serum. Suitable methods for determining the level (%) of cleavage in target tissue versus serum or cleavage by S1 nuclease are described in the "Materials and methods" section. In some embodiments, the biocleavable linker (also referred to as the physiologically labile linker, or nuclease susceptible linker or region B), in a conjugate of the invention, is at least about 20% cleaved, such as at least about 30% cleaved, such as at least about 40% cleaved, such as at least about 50% cleaved, such as at least about 60% cleaved, such as at least about 70% cleaved, such as at least about 75% cleaved when compared against a standard.

In some embodiments, the oligonucleotide conjugate of the invention comprises three regions: i) a first region (region A), which comprises 10-25 contiguous nucleotides complementary to the target nucleic acid; ii) a second region (region B) which comprises a biocleavable linker and iii) a third region (region C) which comprises a conjugate moiety, such as an asialoglycoprotein receptor targeting conjugate moiety, wherein the third region is covalent linked to the second region which is covalently linked to the first region.

In one embodiment of the present invention the oligonucleotide conjugate comprises a biocleavable linker (Region B) between the contiguous nucleotide sequence (region A) and the asialoglycoprotein receptor targeting conjugate moiety (region C).

In some embodiments, the biocleavable linker may be situated either at the 5' end and/or the 3'-end of the contiguous nucleotides complementary to the target nucleic acid (region A). In a preferred embodiment the biocleavable linker is at the 5'-end.

In some embodiments, the cleavable linker is susceptible to nuclease(s) which may for example, be expressed in the target cell. In some embodiments the biocleavable linker is composed of 2 to 5 consecutive phosphodiester linkages. The linker may be a short region (e.g. 1-10 as detailed in the definition of linkers) phosphodiester linked nucleosides. In some embodiments, the nucleosides in the biocleavable linker region B is (optionally independently) selected from the group consisting of DNA and RNA or modifications thereof which do not interfere with nuclease cleavage. Modifications of DNA and RNA nucleosides which do not interfere with nuclease cleavage may be non-naturally occurring nucleobases. Certain sugar-modified nucleosides may also allow nuclease cleavage such as an alpha-L-oxy-LNA. In some embodiments, all the nucleosides of region B comprise (optionally independently) either a 2'-OH ribose sugar (RNA) or a 2'-H sugar—i.e. RNA or DNA. In a preferred embodiment, at least two consecutive nucleosides of region B are DNA or RNA nucleosides (such as at least 3 or 4 or 5 consecutive DNA or RNA nucleosides). In an even more preferred embodiment, the nucleosides of region B are DNA nucleosides Preferably region B consists of between 1 to 5, or 1 to 4, such as 2, 3, 4 consecutive phosphodiester linked DNA nucleosides. In preferred embodiments region B is so short that it does not recruit RNAseH. In some embodiments, region B comprises no more than 3 or no more than 4 consecutive phospodiester linked DNA and/or RNA nucleosides (such as DNA nucleosides).

Where region B is composed of phosphodiester linked nucleosides, region A and B may together form the oligonucleotide that is linked to region C. In this context region A can be differentiated from region B in that Region A starts with at least one, preferably at least two, modified nucleosides with increased binding affinity to the target nucleic acid (e.g. LNA or nucleosides with a 2' substituted sugar moiety) and region A on its own is capable of modulation of the expression the target nucleic acid in a relevant cell line. Furthermore, if region A comprises DNA or RNA nucleosides these are linked with nuclease resistant internucleoside linkage, such phosphorothioate or boranophosphate. Region B on the other hand comprises phophodiester linkages between DNA or RNA nucleosides. In some embodiments region B is not complementary to or comprises at least 50% mismatches to the target nucleic acid.

In some embodiments, region B is not complementary to the target nucleic acid sequence or to the contiguous nucleotides complementary to the target nucleic acid in region A.

In some embodiments, region B is complementary with the target nucleic acid sequence. In this respect region A and B together may form a single contiguous sequence which is complementary to the target sequence.

In some aspects of the invention the internucleoside linkage between the first (region A) and the second region (region B) may be considered part of the second region.

In some embodiments, the sequence of bases in region B is selected to provide an optimal endonuclease cleavage site, based upon the predominant endonuclease cleavage enzymes present in the target tissue or cell or sub-cellular compartment. In this respect, by isolating cell extracts from target tissues and non-target tissues, endonuclease cleavage sequences for use in region B may be selected based upon a preferential cleavage activity in the desired target cell (e.g. liver/hepatocytes) as compared to a non-target cell (e.g. kidney). In this respect, the potency of the compound for target down-regulation may be optimized for the desired tissue/cell.

In some embodiments region B comprises a dinucleotide of sequence AA, AT, AC, AG, TA, TT, TC, TG, CA, CT, CC, CG, GA, GT, GC, or GG, wherein C may be 5-methylcytosine, and/or T may be replaced with U. Preferably, the internucleoside linkage is a phosphodiester linkage. In some embodiments region B comprises a trinucleotide of sequence AAA, AAT, AAC, AAG, ATA, ATT, ATC, ATG, ACA, ACT, ACC, ACG, AGA, AGT, AGC, AGG, TAA, TAT, TAC, TAG, TTA, TTT, TTC, TAG, TCA, TCT, TCC, TCG, TGA, TGT, TGC, TGG, CAA, CAT, CAC, CAG, CTA, CTG, CTC, CTT, CCA, CCT, CCC, CCG, CGA, CGT, CGC, CGG, GAA, GAT, GAC, CAG, GTA, GTT, GTC, GTG, GCA, GCT, GCC, GCG, GGA, GGT, GGC, and GGG wherein C may be 5-methylcytosine and/or T may be replaced with U. Preferably, the internucleoside linkages are phosphodiester linkages. In some embodiments region B comprises a trinucleotide of sequence AAAX, AATX, AACX, AAGX, ATAX, ATTX, ATCX, ATGX, ACAX, ACTX, ACCX, ACGX, AGAX, AGTX, AGCX, AGGX, TAAX, TATX, TACX, TAGX, TTAX, TTTX, TTCX, TAGX, TCAX, TCTX, TCCX, TCGX, TGAX, TGTX, TGCX, TGGX, CAAX, CATX, CACX, CAGX, CTAX, CTGX, CTCX, CTTX, CCAX, CCTX, CCCX, CCGX, CGAX, CGTX, CGCX, CGGX, GAAX, GATX, GACX, CAGX, GTAX, GTTX, GTCX, GTGX, GCAX, GCTX, GCCX, GCGX, GGAX, GGTX, GGCX, and GGGX, wherein X may be selected from the group consisting of A, T, U, G, C and analogues thereof, wherein C may be 5-methylcytosine and/or T may be replaced with U. Preferably, the internucleoside linkages are phosphodiester linkages. It will be recognized that when referring to (naturally occurring) nucleobases A, T, U, G, C, these may be substituted with nucleobase analogues which function as the equivalent natural nucleobase (e.g. base pair with the complementary nucleoside).

Other Linkers (Region Y)

The linker can have at least two functionalities, one for attaching to the oligonucleotide and the other for attaching to the conjugate moiety. Example linker functionalities can be electrophilic for reacting with nucleophilic groups on the oligonucleotide or conjugate moiety, or nucleophilic for reacting with electrophilic groups. In some embodiments, linker functionalities include amino, hydroxyl, carboxylic acid, thiol, phosphoramidate, phosphorothioate, phosphate, phosphite, unsaturations (e.g., double or triple bonds), and the like. Some example linkers (region Y) include 8-amino-3,6-dioxaoctanoic acid (ADO), succinimidyl 4-(N-maleimidomethyl)cyclohexane-I-carboxylate (SMCC), 6-aminohexanoic acid (AHEX or AHA), 6-aminohexyloxy, 4-aminobutyric acid, 4-aminocyclohexylcarboxylic acid, succinimidyl 4-(N-maleimidomethyl) cyclohexane-I-carboxy-(6-amido-caproate) (LCSMCC), succinimidyl m-maleimido-benzoylate (MBS), succinimidyl N-e-maleimido-caproylate (EMCS), succinimidyl 6-(beta-maleimido-propionamido) hexanoate (SMPH), succinimidyl N-(a-maleimido acetate) (AMAS), succinimidyl 4-(p-maleimidophenyl) butyrate (SMPB), beta-alanine (beta-ALA), phenylglycine (PHG), 4-aminocyclohexanoic acid (ACHC), beta-(cyclopropyl) alanine (beta-CYPR), amino dodecanoic acid (ADC), alylene diols, polyethylene glycols, amino acids, and the like. In some embodiments the linker (region Y) is an amino alkyl, such as a C2-C36 amino alkyl group, including, for example C6 to C12 amino alkyl groups. In a preferred embodiment the linker (region Y) is a C6 amino alkyl group. The amino alkyl group may be added to the oligonucleotide (region A or region A-B) as part of standard oligonucleotide synthesis, for example using a (e.g. protected) amino alkyl phosphoramidite. The linkage group between the amino alkyl and the oligonucleotide may for example be a phosphorothioate or a phosphodiester, or one of the other nucleoside linkage groups referred to herein. The amino alkyl group is covalently linked to the 5' or 3'-end of the oligonucleotide. Commercially available amino alkyl linkers are for example 3'-Amino-Modifier reagent for linkage at the 3'-end of the oligonucleotide and for linkage at the 5'-end of an oligonucleotide 5'-Amino-Modifier C6 is available. These reagents are available from Glen Research Corporation (Sterling, Va.). These compounds or similar ones were utilized by Krieg, et al, Antisense Research and Development 1991, 1, 161 to link fluorescein to the 5'-terminus of an oligonucleotide. A wide variety of further linker groups are known in the art and can be useful in the attachment of conjugate moieties to oligonucleotides. A review of many of the useful linker groups can be found in, for example, Antisense Research and Applications, S. T. Crooke and B. Lebleu, Eds., CRC Press, Boca Raton, Fla., 1993, p. 303-350. Other compounds such as acridine have been attached to the 3'-terminal phosphate group of an oligonucleotide via a polymethylene linkage (Asseline, et al., Proc. Natl. Acad. Sci. USA 1984, 81, 3297). Any of the above groups can be used as a single linker (region Y) or in combination with one or more further linkers (region Y-Y' or region Y-B or B-Y).

Linkers and their use in preparation of conjugates of oligonucleotides are provided throughout the art such as in WO 96/11205 and WO 98/52614 and U.S. Pat. Nos. 4,948,882; 5,525,465; 5,541,313; 5,545,730; 5,552,538; 5,580,731; 5,486,603; 5,608,046; 4,587,044; 4,667,025; 5,254,469; 5,245,022; 5,112,963; 5,391,723; 5,510,475; 5,512,667; 5,574,142; 5,684,142; 5,770,716; 6,096,875; 6,335,432; and 6,335,437, WO 2012/083046 each of which is incorporated by reference in its entirety.

Method of Manufacture

In a further aspect, the invention provides methods for manufacturing the oligonucleotides of the invention comprising reacting nucleotide units and thereby forming covalently linked contiguous nucleotide units comprised in the oligonucleotide. Preferably, the method uses phophoramidite chemistry (see for example Caruthers et al, 1987, Methods in Enzymology vol. 154, pages 287-313). In a further embodiment the method further comprises reacting the contiguous nucleotide sequence with a conjugating moiety (ligand). In a further aspect a method is provided for manufacturing the composition of the invention, comprising mixing the oligonucleotide or conjugated oligonucleotide of the invention with a pharmaceutically acceptable diluent, solvent, carrier, salt and/or adjuvant.

Pharmaceutical Composition

In a further aspect, the invention provides pharmaceutical compositions comprising any of the aforementioned oligonucleotides and/or oligonucleotide conjugates and a pharmaceutically acceptable diluent, solvent, carrier, salt and/or adjuvant. A pharmaceutically acceptable diluent includes phosphate-buffered saline (PBS) and pharmaceutically acceptable salts include, but are not limited to, sodium and potassium salts. In some embodiments the pharmaceutically acceptable diluent is sterile phosphate buffered saline. In some embodiments the oligonucleotide is used in the pharmaceutically acceptable diluent at a concentration of 50-300 µM solution.

Suitable formulations for use in the present invention are found in Remington's Pharmaceutical Sciences, Mack Publishing Company, Philadelphia, Pa., 17th ed., 1985. For a brief review of methods for drug delivery, see, e.g., Langer (Science 249:1527-1533, 1990). WO 2007/031091 provides further suitable and preferred examples of pharmaceutically acceptable diluents, carriers and adjuvants (hereby incorporated by reference). Suitable dosages, formulations, administration routes, compositions, dosage forms, combinations with other therapeutic agents, pro-drug formulations are also provided in WO2007/031091.

Oligonucleotides or oligonucleotide conjugates of the invention may be mixed with pharmaceutically acceptable active or inert substances for the preparation of pharmaceutical compositions or formulations. Compositions and methods for the formulation of pharmaceutical compositions are dependent upon a number of criteria, including, but not limited to, route of administration, extent of disease, or dose to be administered.

These compositions may be sterilized by conventional sterilization techniques, or may be sterile filtered. The resulting aqueous solutions may be packaged for use as is, or lyophilized, the lyophilized preparation being combined with a sterile aqueous carrier prior to administration. The pH of the preparations typically will be between 3 and 11, more preferably between 5 and 9 or between 6 and 8, and most preferably between 7 and 8, such as 7 to 7.5. The resulting compositions in solid form may be packaged in multiple single dose units, each containing a fixed amount of the above-mentioned agent or agents, such as in a sealed package of tablets or capsules. The composition in solid form can also be packaged in a container for a flexible quantity, such as in a squeezable tube designed for a topically applicable cream or ointment.

In some embodiments, the oligonucleotide or oligonucleotide conjugate of the invention is a prodrug. In particular with respect to oligonucleotide conjugates the conjugate moiety is cleaved of the oligonucleotide once the prodrug is delivered to the site of action, e.g. the target cell.

Applications

The oligonucleotides or oligonucleotide conjugates of the present invention may be utilized as research reagents for, for example, diagnostics, therapeutics and prophylaxis.

In research, such oligonucleotides or oligonucleotide conjugates may be used to specifically modulate the synthesis of PD-L1 protein in cells (e.g. in vitro cell cultures) and experimental animals thereby facilitating functional analysis of the target or an appraisal of its usefulness as a target for therapeutic intervention. Typically the target modulation is achieved by degrading or inhibiting the mRNA producing the protein, thereby prevent protein formation or by degrading or inhibiting a modulator of the gene or mRNA producing the protein.

If employing the oligonucleotide of the invention in research or diagnostics the target nucleic acid may be a cDNA or a synthetic nucleic acid derived from DNA or RNA.

The present invention provides an in vivo or in vitro method for modulating PD-L1 expression in a target cell which is expressing PD-L1, said method comprising administering an oligonucleotide or oligonucleotide conjugate of the invention in an effective amount to said cell.

In some embodiments, the target cell, is a mammalian cell in particular a human cell. The target cell may be an in vitro cell culture or an in vivo cell forming part of a tissue in a mammal. In preferred embodiments the target cell is present in the liver. Liver target cell can be selected from parenchymal cells (e.g. hepatocytes) and non-parenchymal cells such as Kupffer cells, LSECs, stellate cells (or Ito cells), cholangiocytes and liver-associated leukocytes (including T cells and NK cells). In some embodiments the target cell is an antigen-presenting cell. Antigen-presenting cells displays foreign antigens complexed with major histocompatibility complex (MHC) class I or class II on their surfaces. In some embodiments the antigen-presenting cell expresses MHC class II (i.e. professional antigen-presenting cells such as dendritic cells, macrophages and B cells).

In diagnostics the oligonucleotides may be used to detect and quantitate PD-L1 expression in cell and tissues by northern blotting, in-situ hybridisation or similar techniques.

For therapeutics oligonucleotides or oligonucleotide conjugates of the present invention or pharmaceutical compositions thereof may be administered to an animal or a human, suspected of having a disease or disorder, which can be alleviated or treated by reduction of the expression of PD-L1, in particular by reduction of the expression of PD-L1 in liver target cells.

The invention provides methods for treating or preventing a disease, comprising administering a therapeutically or prophylactically effective amount of an oligonucleotide, an oligonucleotide conjugate or a pharmaceutical composition of the invention to a subject suffering from or susceptible to the disease.

The invention also relates to an oligonucleotide, oligonucleotide conjugate or a pharmaceutical composition according to the invention for use as a medicament.

The oligonucleotide, oligonucleotide conjugate or a pharmaceutical composition according to the invention is typically administered in an effective amount.

The invention also provides for the use of the oligonucleotide or oligonucleotide conjugate or pharmaceutical composition of the invention as described for the manufacture of a medicament for the treatment of a disease or disorder as referred to herein. In one embodiment the disease is selected from a) viral liver infections such as HBV, HCV and HDV;

b) parasite infections such as malaria, toxoplasmosis, leishmaniasis and trypanosomiasis and c) liver cancer or metastases in the liver.

In one embodiment, the invention relates to oligonucleotides, oligonucleotide conjugates or pharmaceutical compositions for use in the treatment of diseases or disorders selected from viral or parasitic infections. In a further embodiment the disease is selected from a) viral liver infections such as HBV, HCV and HDV; b) parasite infections such as malaria, toxoplasmosis, leishmaniasis and trypanosomiasis and c) liver cancer or metastases in the liver.

The disease or disorder, as referred to herein, is associated with immune exhaustion. In particular the disease or disorder is associated with exhaustion of virus-specific T-cell responses. In some embodiments disease or disorder may be alleviated or treated by reduction of PD-L1 expression.

The methods of the invention are preferably employed for treatment or prophylaxis against diseases associated with immune exhaustion.

In one embodiment of the invention the oligonucleotide, oligonucleotide conjugate or pharmaceutical compositions of the invention are used in restoration of immune response against a liver cancer or metastases in the liver.

In one embodiment of the invention the oligonucleotide, oligonucleotide conjugate or pharmaceutical compositions of the invention are used in restoration of immune response against a pathogen. In some embodiments the pathogen can be found in the liver. The pathogens can be a virus or a parasite, in particular those described herein. In a preferred embodiment the pathogen is HBV.

The invention further relates to use of an oligonucleotide, oligonucleotide conjugate or a pharmaceutical composition as defined herein for the manufacture of a medicament for the restoration of immunity against a viral or parasite infection as mentioned herein.

Oligonucleotides or oligonucleotide conjugates or pharmaceutical compositions of the present invention can be used in the treatment of viral infections, in particular viral infections in the liver where the PD-1 patheway is affected (see for example Kapoor and Kottilil 2014 Future Virol Vol. 9 pp. 565-585 and Salem and El-Badawy 2015 World J Hepatol Vol. 7 pp. 2449-2458). Viral liver infections can be selected from the group consisting of hepatitis viruses, in particular HBV, HCV and HDV, in particular chronic forms of these infections. In one embodiment the oligonucleotides or oligonucleotide conjugates or pharmaceutical compositions of the present invention are used to treat HBV, in particular chronic HBV. Indicators of chronic HBV infections are high levels of viral load (HBV DNA) and even higher levels of empty HBsAg particles (>100-fold in excess of virions) in the circulation.

Oligonucleotides or oligonucleotide conjugates of the present invention can also be used to treat viral liver infections that occur as co-infections with HIV. Other viral infections which can be treated with the oligonucleotides or oligonucleotide conjugates or pharmaceutical compositions of the present invention are lcmv (Lymphocytic Choriomeningitis Virus), and HIV as a mono infection, HSV-1 and -2, and other herpesviruses. These viruses are not hepatotrophic, however they may be sensitive to PDL1 down regulation.

In some embodiments the restoration of immunity or immune response involves improvement of the T-cell and/or NK cell response and/or alleviation of the T-cell exhaustion, in particular the HBV-specific T-cell response, the HCV-specific T-cell response and or the HDV-specific T-cell response is restored. An improvement of the T cell response can for example be assessed as an increase in T cells in the liver, in particular an increase in CD8+ and/or CD4+ T cells when compared to a control (e.g. the level prior to treatment or the level in a vehicle treated subject) In a further embodiment it is the virus specific CD8+ T cells that are restored or increased when compared to cotrol), in particular HBV specific CD8+ T cells or HCV specific CD8+ T cells or HDV specific CD8+ T cells are restored or increased when compared to control. In a preferred embodiment CD8+ T cells specific for HBV s antigen (HBsAg) and/or CD8+ T cells specific for HBV e antigen (HBeAg) and/or CD8+ T cells specific for HBV core antigen (HBcAg) are increased in subjects treated with an oligonucleotide, oligonucleotide conjugate or pharmaceutical composition of the present invention compared to control. Preferably the HBV antigen specific CD8+ T cells produce one or more cytokines, such as interferon-gamma (IFN-γ) or tumor necrosis factor alpha (TNF-α). The increase in CD8+ T cells described above is in particular observed in the liver. The increase described herein should be statistically significant when compared to a control. Preferably the increase is at least 20%, such as 25%, such as 50% such as 75% when compared to control. In another embodiment natural killer (NK) cells and/or natural killer T (NKT) cells are activated by the oligonucleotides or oligonucleotide conjugates of the present invention.

Oligonucleotides or oligonucleotide conjugates or pharmaceutical compositions of the present invention can be used in the treatment parasite infections, in particular parasite infections where the PD-1 pathway is affected (see for example Bhadra et al. 2012 J Infect Dis vol 206 pp. 125-134; Bhadra et al. 2011 Proc Natl Acad Sci USA Vol. 108 pp. 9196-9201; Esch et al. J Immunol vol 191 pp 5542-5550; Freeman and Sharpe 2012 Nat Immunol Vol 13 pp. 113-115; Gutierrez et al. 2011 Infect Immun Vol 79 pp. 1873-1881; Joshi et al. 2009 PLOS Pathog Vol 5 e1000431; Liang et al. 2006 Eur J Immunol Vol. 36 pp 58-64; Wykes et al. 2014 Front Microbiol Vol 5 pp 249). Parasite infections can be selected from the group consisting of malaria, toxoplasmosis, leishmaniasis and trypanosomiasis. Malaria infection is caused by protozoa of the genus *Plasmodium*, in particular of the species *P. vivax, P. malariae* and *P. falciparum*. Toxoplasmosis is a parasitic disease caused by *Toxoplasma gondii*. Leishmaniasis is a disease caused by protozoan parasites of the genus *Leishmania*. Trypanosomiasis is caused by the protozoan of the genus *Trypanosoma*. Chaga disease which is the tropical form caused by the species *Trypanosoma cruzi*, and sleeping disease is caused by the species *Trypanosoma brucei*.

In some embodiments the restoration of immunity involves restoration of a parasite-specific T cell and NK cell response, in particular a *Plasmodium*-specific T-cell response, a *Toxoplasma gondii*-specific T-cell and NK cell response, a *Leishmania*-specific T-cell and NK cell response, a *Trypanosoma cruzi*-specific T-cell and NK cell response or a *Trypanosoma brucei*-specific T-cell and NK cell response. In a further embodiment it is the parasite-specific CD8+ T cell and NK cell response that is restored.

Administration

The oligonucleotides or pharmaceutical compositions of the present invention may be administered topical (such as, to the skin, inhalation, ophthalmic or otic) or enteral (such as, orally or through the gastrointestinal tract) or parenteral (such as, intravenous, subcutaneous, intra-muscular, intracerebral, intracerebroventricular or intrathecal).

In a preferred embodiment the oligonucleotide or pharmaceutical compositions of the present invention are administered by a parenteral route including intravenous, intraarterial, subcutaneous, intraperitoneal or intramuscular injection or infusion, intrathecal or intracranial, e.g. intracerebral or intraventricular, intravitreal administration. In one embodiment the active oligonucleotide or oligonucleotide conjugate is administered intravenously. In another embodiment the active oligonucleotide or oligonucleotide conjugate is administered subcutaneously.

In some embodiments, the oligonucleotide, oligonucleotide conjugate or pharmaceutical composition of the invention is administered at a dose of 0.1-15 mg/kg, such as from 0.1-10 mg/kg, such as from 0.2-10 mg/kg, such as from 0.25-10 mg/kg, such as from 0.1-5 mg/kg, such as from 0.2-5 mg/kg, such as from 0.25-5 mg/kg. The administration can be once a week, every $2^{nd}$ week, every third week or even once a month.

Combination Therapies

In some embodiments the oligonucleotide, oligonucleotide conjugate or pharmaceutical composition of the invention is for use in a combination treatment with another therapeutic agent. The therapeutic agent can for example be the standard of care for the diseases or disorders described above.

For the treatment of chronic HBV infections a combination of antiviral drugs and immune system modulators is recommended as standard of care. The antiviral drugs effective against HBV are for example nucleos (t) ide analogs. There are five nucleos (t) ide analogs licensed for therapy of HBV namely lamivudine (Epivir), adefovir (Hepsera), tenofovir (Viread), telbivudine (Tyzeka), entecavir (Baraclude) these are effective in suppressing viral replication (HBV DNA) but have no effect on HBsAg levels. Other antiviral drugs include ribavirin and an HBV antibody therapy (monoclonal or polyclonal). The immune system modulators can for example be interferon alpha-2a and PEGylated interferon alpha-2a (Pegasys) or TLR7 agonists (e.g. GS-9620) or therapeutic vaccines. IFN-α treatment show only very modest effect in reducing viral load, but result in some HBsAg decline, albeit very inefficiently (<10% after 48 week therapy).

The oligonucleotide or oligonucleotide conjugates of the present invention may also be combined with other antiviral drugs effective against HBV such as the antisense oligonucleotides described in WO2012/145697 and WO 2014/179629 or the siRNA molecules described in WO 2005/014806, WO 2012/024170, WO 2012/2055362, WO 2013/003520 and WO 2013/159109.

When the oligonucleotides or oligonucleotide conjugates of this invention are administered in combination therapies with other agents, they may be administered sequentially or concurrently to an individual. Alternatively, pharmaceutical compositions according to the present invention may be comprised of a combination of an oligonucleotide or oligonucleotide conjugate of the present invention in association with a pharmaceutically acceptable excipient, as described herein, and another therapeutic or prophylactic agent known in the art.

EMBODIMENTS

The following embodiments of the present invention may be used in combination with any other embodiments described herein.

1. An antisense oligonucleotide which comprises or consists of a contiguous nucleotide sequence of 10 to 30 nucleotides in length capable of reducing the expression of PD-L1.
2. The oligonucleotide of embodiment 1, wherein the contiguous nucleotide sequence is at least 90% complementarity to a PD-L1 target nucleic acid.
3. The oligonucleotide of embodiment 1 or 2, wherein the contiguous nucleotide sequence is complementary to a target nucleic acid selected from the group consisting of SEQ ID NO: 1, SEQ ID NO: 2 and/or SEQ ID NO: 3.
4. The oligonucleotide of embodiment 1 to 3, wherein the contiguous nucleotide sequence is complementary to a region within position 1 and 15720 on SEQ ID NO: 1.
5. The oligonucleotide of embodiment 1 to 4, wherein the oligonucleotide is capable of hybridizing to a target nucleic acid of selected from the group consisting of SEQ ID NO: 1, SEQ ID NO: 2 and/or SEQ ID NO: 3 with a ΔG° below-10 kcal.
6. The oligonucleotide of embodiment 1 to 5, wherein the contiguous nucleotide sequence is complementary to a sub-sequence of the target nucleic acid, wherein the sub-sequence is selected from the group consisting of position 371-3068, 5467-12107, 15317-15720, 15317-18083, 15317-19511 and 18881-19494 on SEQ ID NO: 1.
7. The oligonucleotide of embodiment 6, wherein the sub-sequence is selected from the group consisting of position 7300-7333, 8028-8072, 9812-9859, 11787-11873 and 15690-15735 on SEQ ID NO: 1.
8. The oligonucleotide of embodiment 2 to 7, wherein the target nucleic acid is RNA.
9. The oligonucleotide of embodiment 8, wherein the RNA is mRNA.
10. The oligonucleotide of embodiment 9, wherein the mRNA is pre-mRNA or mature mRNA.
11. The oligonucleotide of embodiment 1-10, wherein the contiguous nucleotide sequence comprises or consists of at least 14 contiguous nucleotides, particularly 15, 16, 17, 18, 19, 20, 21, 22, 23 or 24 contiguous nucleotides.
12. The oligonucleotide of embodiment 1-10, wherein the contiguous nucleotide sequence comprises or consists of from 16 to 20 nucleotides.
13. The oligonucleotide of embodiment 1-10, wherein the oligonucleotide comprises or consists of 14 to 35 nucleotides in length.
14. The oligonucleotide of embodiment 13, wherein the oligonucleotide comprises or consists of 18 to 22 nucleotides in length.
15. The oligonucleotide of embodiment 1-14, wherein the oligonucleotide or contiguous nucleotide sequence is single stranded.
16. The oligonucleotide of embodiment 1-15, wherein the contiguous nucleotide sequence is complementary to a sub-sequence of the target nucleic acid, wherein the subsequence is selected from the group consisting of A7, A26, A43, A119, A142, A159, A160, A163, A169, A178, A179, A180, A189, A201, A202, A204, A214, A221, A224, A226, A243, A254, A258, 269, A274, A350, A360, A364, A365, A370, A372, A381, A383, A386, A389, A400, A427, A435 and A438.
17. The oligonucleotide of embodiment 16, wherein the subsequence is selected from the group consisting of A221, A360, A180, A160 and A269.

18. The oligonucleotide of embodiment 1-17, wherein the oligonucleotide is not siRNA and is not self-complementary.
19. The oligonucleotide of embodiment 1-18, wherein the contiguous nucleotide sequence comprises or consists of a sequence selected from SEQ ID NO: 5 to 743 or 771.
20. The oligonucleotide of embodiment 1-19, wherein the contiguous nucleotide sequence comprises or consists of a sequence selected from SEQ ID NO: 6, 8, 9, 13, 41, 42, 58, 77, 92, 111, 128, 151, 164, 166, 169, 171, 222, 233, 245, 246, 250, 251, 252, 256, 272, 273, 287, 292, 303, 314, 318, 320, 324, 336, 342, 343, 344, 345, 346, 349, 359, 360, 374, 408, 409, 415, 417, 424, 429, 430, 458, 464, 466, 474, 490, 493, 512, 519, 519, 529, 533, 534, 547, 566, 567, 578, 582, 601, 619, 620, 636, 637, 638, 640, 645, 650, 651, 652, 653, 658, 659, 660, 665, 678, 679, 680, 682, 683, 684, 687, 694, 706, 716, 728, 733, 734, and 735.
21. The oligonucleotide of embodiment 1-20, wherein the contiguous nucleotide sequence comprises or consists of a sequence selected from SEQ ID NO: 466, 640, 342, 287 and 566.
22. The oligonucleotide of embodiment 1-21 wherein the contiguous nucleotide sequence has zero to three mismatches compared to the target nucleic acid it is complementary to.
23. The oligonucleotide of embodiment 22, wherein the contiguous nucleotide sequence has one mismatch compared to the target nucleic acid.
24. The oligonucleotide of embodiment 22, wherein the contiguous nucleotide sequence has two mismatches compared to the target nucleic acid.
25. The oligonucleotide of embodiment 22, wherein the contiguous nucleotide sequence is fully complementary to the target nucleic acid sequence.
26. The oligonucleotide of embodiment 1-25, comprising one or more modified nucleosides.
27. The oligonucleotide of embodiment 26, wherein the one or more modified nucleoside is a high-affinity modified nucleosides.
28. The oligonucleotide of embodiment 26 or 27, wherein the one or more modified nucleoside is a 2' sugar modified nucleoside.
29. The oligonucleotide of embodiment 28, wherein the one or more 2' sugar modified nucleoside is independently selected from the group consisting of 2'-O-alkyl-RNA, 2'-O-methyl-RNA, 2'-alkoxy-RNA, 2'-O-methoxyethyl-RNA, 2'-amino-DNA, 2'-fluoro-DNA, 2'-fluoro-ANA and LNA nucleosides.
30. The oligonucleotide of embodiment 28, wherein the one or more modified nucleoside is a LNA nucleoside.
31. The oligonucleotide of embodiment 30, wherein the modified LNA nucleoside is oxy-LNA.
32. The oligonucleotide of embodiment 31, wherein the modified nucleoside is beta-D-oxy-LNA.
33. The oligonucleotide of embodiment 30, wherein the modified nucleoside is thio-LNA.
34. The oligonucleotide of embodiment 30, wherein the modified nucleoside is amino-LNA.
35. The oligonucleotide of embodiment 30, wherein the modified nucleoside is cET.
36. The oligonucleotide of embodiment 30, wherein the modified nucleoside is ENA.
37. The oligonucleotide of embodiment 30, wherein the modified LNA nucleoside is selected from beta-D-oxy-LNA, alpha-L-oxy-LNA, beta-D-amino-LNA, alpha-L-amino-LNA, beta-D-thio-LNA, alpha-L-thio-LNA, (S)cET, (R)cET beta-D-ENA and alpha-L-ENA.
38. The oligonucleotide of embodiment 30-37, wherein there in addition to the modified LNA nucleoside is at least one 2' substituted modified nucleoside.
39. The oligonucleotide of embodiment 38, wherein the 2' substituted modified nucleoside is selected from the group consisting of 2'-O-alkyl-RNA, 2'-O-methyl-RNA, 2'-alkoxy-RNA, 2'-O-methoxyethyl-RNA (MOE), 2'-amino-DNA, 2'-fluoro-DNA, 2'-fluoro-ANA.
40. The oligonucleotide of any one of embodiments 1-39, wherein the oligonucleotide comprises at least one modified internucleoside linkage.
41. The oligonucleotide of embodiment 40, wherein the modified internucleoside linkage is nuclease resistant.
42. The oligonucleotide of embodiment 40 or 41, wherein at least 50% of the internucleoside linkages within the contiguous nucleotide sequence are phosphorothioate internucleoside linkages or boranophosphate internucleoside linkages.
43. The oligonucleotide of embodiment 40 or 41, wherein all the internucleoside linkages within the contiguous nucleotide sequence are phosphorothioate internucleoside linkages.
44. The oligonucleotide of embodiment 1-43, wherein the oligonucleotide is capable of recruiting RNase H.
45. The oligonucleotide of embodiment 44, wherein the oligonucleotide is a gapmer.
46. The oligonucleotide of embodiment 44 or 45, wherein the oligonucleotide is a gapmer of formula 5'-F-G-F'-3', where region F and F' independently comprise or consist of 1-7 modified nucleosides and G is a region between 6 and 16 nucleosides which are capable of recruiting RNaseH.
47. The oligonucleotide of embodiment 44 or 45, wherein the gapmer has formula 5'-D'-F-G-F'-3' or 5'-F-G-F'-D"-3', where region F and F' independently comprise 1-7 modified nucleosides, G is a region between 6 and 16 nucleosides which are capable of recruiting RNaseH and region D' or D" comprise 1-5 phosphodiester linked nucleosides.
48. The oligonucleotide of embodiment 47, wherein D' or D" are optional.
49. The oligonucleotide of embodiment 47, wherein region D' consist of two phosphodiester linked nucleosides.
50. The oligonucleotide of embodiment 49, wherein the phosphodiester linked nucleosides are ca (cytidine-adenosine).
51. The oligonucleotide of embodiment 46 or 47, wherein the modified nucleoside is a 2' sugar modified nucleoside independently selected from the group consisting of 2'-O-alkyl-RNA, 2'-O—methyl-RNA, 2'-alkoxy-RNA, 2'-O-methoxyethyl-RNA, 2'-amino-DNA, 2'-fluoro-DNA, arabino nucleic acid (ANA), 2'-fluoro-ANA and LNA nucleosides.
52. The oligonucleotide of embodiments 46 to 51, wherein one or more of the modified nucleosides in region F and F' is a LNA nucleoside.
53. The oligonucleotide of embodiment 52, wherein all the modified nucleosides in region F and F' are LNA nucleosides.
54. The oligonucleotide of embodiment 53, wherein region F and F' consist of LNA nucleosides.

55. The oligonucleotide of embodiment 52-54, wherein all the modified nucleosides in region F and F' are oxy-LNA nucleosides.
56. The oligonucleotide of embodiment 52, wherein at least one of region F or F' further comprises at least one 2' substituted modified nucleoside independently selected from the group consisting of 2'-O-alkyl-RNA, 2'-O-methyl-RNA, 2'-alkoxy-RNA, 2'-O-methoxyethyl-RNA, 2'-amino-DNA and 2'-fluoro-DNA.
57. The oligonucleotide of embodiment 46-56, wherein the RNaseH recruiting nucleosides in region G are independently selected from DNA, alpha-L-LNA, $C_4'$ alkylated DNA, ANA and 2'F-ANA and UNA.
58. The oligonucleotide of embodiment 57, wherein the nucleosides in region G is DNA and/or alpha-L-LNA nucleosides.
59. The oligonucleotide of embodiment 57 or 58, wherein region G consists of at least 75% DNA nucleosides.
60. The oligonucleotide of embodiment 1-59, wherein the oligonucleotide is selected from any one of the CMP ID NO: 5_1 to 743_1 and 771_1 (table 5).
61. The oligonucleotide of embodiment 1-60, wherein the oligonucleotide is selected from the group consisting of CMP ID NO: 6_1, 8_1, 9_1, 13_1, 41_1, 42_1, 58_1, 77_1, 92_1, 111_1, 128_1, 151_1, 164_1, 166_1, 169_1, 171_1, 222_1, 233_1, 245_1, 246_1, 250_1, 251_1, 252_1, 256_1, 272_1, 273_1, 287_1, 292_1, 303_1, 314_1, 318_1, 320_1, 324_1, 336_1, 342_1, 343_1, 344_1, 345_1, 346_1, 349_1, 359_1, 360_1, 374_1, 408_1, 409_1, 415_1, 417_1, 424_1, 429_1, 430_1, 458_1, 464_1, 466_1, 474_1, 490_1, 493_1, 512_1, 519_1, 519_1, 529_1, 533_1, 534_1, 547_1, 566_1, 567_1, 578_1,582_1,601_1,619_1,620_1, 636_1, 637_1, 638_1, 640_1, 645_1, 650_1, 651_1, 652_1, 653_1, 658_1, 659_1, 660_1, 665_1, 678_1, 679_1, 680_1, 682_1, 683_1, 684_1, 687_1, 694_1, 706_1, 716_1, 728_1, 733_1, 734_1, and 735_1.
62. The oligonucleotide of embodiment 1-61, wherein the oligonucleotide is selected from the group consisting of CMP ID NO: 287_1, 342_1, 466_1, 640_1, 566_1, 766_1, 767_1, 768_1, 769_1 and 770_1.
63. An antisense oligonucleotide conjugate comprising
    a. an oligonucleotide according to any one of claims 1-62 (Region A); and
    b. at least one at least one conjugate moiety (Region C) covalently attached to said oligonucleotide.
64. The oligonucleotide conjugate of embodiment 63, wherein the conjugate moiety is selected from carbohydrates, cell surface receptor ligands, drug substances, hormones, lipophilic substances, polymers, proteins, peptides, toxins, vitamins, viral proteins or combinations thereof.
65. The oligonucleotide conjugate of embodiment 63 or 64, wherein the conjugate moiety is a carbohydrate containing moiety.
66. The oligonucleotide conjugate of embodiment 65, wherein the carbohydrate conjugate moiety comprises at least one asialoglycoprotein receptor targeting moiety covalently attached to an oligonucleotide according to any one of claims 1-62.
67. The oligonucleotide conjugate of embodiment 66, wherein the asialoglycoprotein receptor targeting conjugate moiety comprises at least one carbohydrate moiety selected from group consisting of galactose, galactosamine, N-formyl-galactosamine, N-acetylgalactosamine, N-propionyl-galactosamine, N-n-butanoyl-galactosamine and N-isobutanoylgalactosamine.
68. The oligonucleotide conjugate of embodiment 66 or 67, wherein the asialoglycoprotein receptor targeting conjugate moiety is mono-valent, di-valent, tri-valent or tetra-valent.
69. The oligomer conjugate of embodiment 68, wherein the asialoglycoprotein receptor targeting conjugate moiety consists of two to four terminal GalNAc moieties, a PEG spacer linking each GalNAc moiety to a brancher molecule.
70. The oligonucleotide conjugate of embodiment 66 to 69, wherein the asialoglycoprotein receptor targeting conjugate moiety is a tri-valent N-acetylgalactosamine (GalNAc) moiety.
71. The oligonucleotide conjugate of embodiment 66 to 70, wherein the conjugate moiety is selected from one of the trivalent GalNAc moieties in FIG. 1.
72. The oligonucleotide conjugate of embodiment 71, wherein the conjugate moiety is the trivalent GalNAc moiety in FIG. 3.
73. The oligonucleotide conjugate of embodiment 63-72, where a linker is present between the oligonucleotide or contiguous oligonucleotide sequence and the conjugate moiety.
74. The oligonucleotide conjugate of embodiment 73, wherein the linker is a physiologically labile linker (region B).
75. The oligonucleotide conjugate of embodiment 74, wherein the physiologically labile linker is nuclease susceptible linker.
76. The oligonucleotide conjugate of embodiment 74 or 75, wherein the physiologically labile linker is composed of 2 to 5 consecutive phosphodiester linkages.
77. The oligonucleotide conjugate of embodiment 76, wherein the physiologically labile linker is equivalent to region D' or D" presented in embodiment 47 to 50.
78. The oligonucleotide conjugate of any one of embodiments 63-77, wherein the oligonucleotide conjugate is selected from CMP ID NO: 766_2, 767_2,768_2, 769_2 and 770_2.
79. The oligonucleotide conjugate of embodiment 78, wherein the oligonucleotide conjugate is selected from the oligonucleotide conjugated represented in FIGS. 4, 5, 6, 7 and 8.
80. The oligonucleotide conjugate of embodiment 63-76, which display improved inhibition of PD-L1 in the target cell, or improved cellular distribution between liver and the spleen or improved cellular uptake into the liver of the conjugate oligonucleotide as compared to an unconjugated oligonucleotide.
81. A pharmaceutical composition comprising the oligonucleotide of embodiment 1-62 or a conjugate of embodiment 63-80 and a pharmaceutically acceptable diluent, carrier, salt and/or adjuvant.
82. A method for manufacturing the oligonucleotide of embodiment 1-62, comprising reacting nucleotide units thereby forming covalently linked contiguous nucleotide units comprised in the oligonucleotide.
83. The method of embodiment 82, further comprising reacting the contiguous nucleotide sequence with a non-nucleotide conjugation moiety.
84. A method for manufacturing the composition of embodiment 81, comprising mixing the oligonucleotide with a pharmaceutically acceptable diluent, carrier, salt and/or adjuvant.

85. An in vivo or in vitro method for modulating PD-L1 expression in a target cell which is expressing PD-L1, said method comprising administering an oligonucleotide of embodiment 1-62 or a conjugate of embodiment 63-80 or the pharmaceutical composition of embodiment 81 in an effective amount to said cell.
86. A method for treating or preventing a disease comprising administering a therapeutically or prophylactically effective amount of an oligonucleotide of embodiment 1-62 or a conjugate of embodiment 63-80 or the pharmaceutical composition of embodiment 81 to a subject suffering from or susceptible to the disease.
87. A method for restoration of immunity against a virus or parasite comprising administering a therapeutically or prophylactically effective amount of an oligonucleotide conjugate of embodiment 63-80 or the oligonucleotide of embodiment 1-62 or the pharmaceutical composition of embodiment 81 to a subject infected with a virus or parasite.
88. The method of embodiment 87, the restoration of immunity is an increase in the liver of CD8+ T cells specific to one or more HBV antigens when compared to a control.
89. The oligonucleotide of embodiment 1-62 or a conjugate of embodiment 63-80 or the pharmaceutical composition of embodiment 81, for use as a medicament for treatment or prevention of a disease in a subject.
90. Use of the oligonucleotide of oligonucleotide of embodiment 1-62 or a conjugate of embodiment 63-80 for the preparation of a medicament for treatment or prevention of a disease in a subject.
91. The oligonucleotide of embodiment 1-62 or a conjugate of embodiment 63-80 or the pharmaceutical composition of embodiment 81, for use in restoration of immunity against a virus or parasite.
92. The use of embodiment 91, wherein the restoration of immunity is an increase in the liver of CD8+ T cells specific to one or more HBV antigens when compared to a control.
93. The use of embodiment 92, wherein the HBV antigen is the HBsAg.
94. The method, the oligonucleotide or the use of embodiments 86-93, wherein the disease is associated with in vivo activity of PD-L1.
95. The method, the oligonucleotide or the use of embodiments 86-94, wherein the disease is associated with increased expression of PD-L1 in an antigen presenting cell.
96. The method, the oligonucleotide or the use of embodiments 95, wherein the PD-L1 is reduced by at least 30%, or at least or at least 40%, or at least 50%, or at least 60%, or at least 70%, or at least 80%, or at least 90%, or at least 95% compared to the expression without or before treatment with the oligonucleotide of embodiment 1-62 or a conjugate of embodiment 63-80 or the pharmaceutical composition of embodiment 81.
97. The method, the oligonucleotide or the use of embodiments 86-95, wherein the disease is selected from a viral liver infection or a parasite infections.
98. The method, the oligonucleotide or the use of embodiment 98, wherein the viral infection is HBV, HCV or HDV.
99. The method, the oligonucleotide or the use of embodiment 86-95, wherein the disease is chronic HBV.
100. The method, the oligonucleotide or the use of embodiment 98, wherein the parasite infection is malaria, toxoplasmosis, leishmaniasis or trypanosomiasis.
101. The method, the oligonucleotide or the use of embodiments 86-100, wherein the subject is a mammal.
102. The method, the oligonucleotide or the use of embodiment 101, wherein the mammal is human.

EXAMPLES

Materials and Methods

Motif Sequences and Oligonucleotide Compounds

TABLE 5 list of oligonucleotide motif sequences (indicated by SEQ ID NO) targeting the human PD-L1 transcript (SEQ ID NO: 1), designs of these, as well as specific antisense oligonucleotide compounds (indicated by CMP ID NO) designed based on the motif sequence.

| SEQ ID NO | Motif sequence | Design | Oligonucleotide Compound | CMP ID NO | Start ID NO: 1 | dG |
| --- | --- | --- | --- | --- | --- | --- |
| 5 | taattggctctactgc | 2-11-3 | TAattggctctacTGC | 5_1 | 236 | -20 |
| 6 | tcgcataagaatgact | 4-10-2 | TCGCataagaatgaCT | 6_1 | 371 | -19 |
| 7 | tgaacacacagtcgca | 2-12-2 | TGaacacacagtcgCA | 7_1 | 382 | -19 |
| 8 | ctgaacacacagtcgc | 3-10-3 | CTGaacacacagtCGC | 8_1 | 383 | -22 |
| 9 | tctgaacacacagtcg | 3-11-2 | TCTgaacacacagtCG | 9_1 | 384 | -19 |
| 10 | ttctgaacacacagtc | 3-11-2 | TTCtgaacacacagTC | 10_1 | 385 | -17 |
| 11 | acaagtcatgttacta | 2-11-3 | ACaagtcatgttaCTA | 11_1 | 463 | -16 |
| 12 | acacaagtcatgttac | 2-12-2 | ACacaagtcatgttAC | 12_1 | 465 | -14 |
| 13 | cttacttagatgctgc | 2-11-3 | CTtacttagatgcTGC | 13_1 | 495 | -20 |
| 14 | acttacttagatgctg | 2-11-3 | ACttacttagatgCTG | 14_1 | 496 | -18 |
| 15 | gacttacttagatgct | 3-11-2 | GACttacttagatgCT | 15_1 | 497 | -19 |
| 16 | agacttacttagatgc | 2-11-3 | AGacttacttagaTGC | 16_1 | 498 | -18 |

TABLE 5-continued list of oligonucleotide motif sequences (indicated by SEQ ID NO) targeting the human PD-L1 transcript (SEQ ID NO: 1), designs of these, as well as specific antisense oligonucleotide compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 17 | gcaggaagagacttac | 3-10-3 | GCAggaagagactTAC | 17_1 | 506 | -20 |
| 18 | aataaattccgttcagg | 4-9-4 | AATAaattccgttCAGG | 18_1 | 541 | -22 |
| 19 | gcaaataaattccgtt | 3-10-3 | GCAaataaattccGTT | 19_2 | 545 | -18 |
| 19 | gcaaataaattccgtt | 4-8-4 | GCAAataaattcCGTT | 19_1 | 545 | -20 |
| 20 | agcaaataaattccgt | 4-9-3 | AGCAaataaattcCGT | 20_1 | 546 | -20 |
| 21 | cagagcaaataaattcc | 4-10-3 | CAGAgcaaataaatTCC | 21_1 | 548 | -21 |
| 22 | tggacagagcaaataaat | 4-11-3 | TGGAcagagcaaataAAT | 22_1 | 551 | -19 |
| 23 | atggacagagcaaata | 4-8-4 | ATGGacagagcaAATA | 23_1 | 554 | -20 |
| 24 | cagaatggacagagca | 2-11-3 | CAgaatggacagaGCA | 24_1 | 558 | -21 |
| 25 | ttctcagaatggacag | 3-11-2 | TTCtcagaatggacAG | 25_1 | 562 | -17 |
| 26 | ctgaactttgacatag | 4-8-4 | CTGAactttgacATAG | 26_1 | 663 | -20 |
| 27 | aagacaaacccagactga | 2-13-3 | AAgacaaacccagacTGA | 27_1 | 675 | -21 |
| 28 | tataagacaaacccagac | 4-10-4 | TATAagacaaacccAGAC | 28_1 | 678 | -22 |
| 29 | ttataagacaaacccaga | 4-10-4 | TTATaagacaaaccCAGA | 29_1 | 679 | -23 |
| 30 | tgttataagacaaaccc | 4-10-3 | TGTTataagacaaaCCC | 30_1 | 682 | -22 |
| 31 | tagaacaatggtacttt | 4-9-4 | TAGAacaatggtaCTTT | 31_1 | 708 | -20 |
| 32 | gtagaacaatggtact | 4-10-2 | GTAGaacaatggtaCT | 32_1 | 710 | -19 |
| 33 | aggtagaacaatggta | 3-10-3 | AGGtagaacaatgGTA | 33_1 | 712 | -19 |
| 34 | aagaggtagaacaatgg | 4-9-4 | AAGAggtagaacaATGG | 34_1 | 714 | -21 |
| 35 | gcatccacagtaaatt | 2-12-2 | GCatccacagtaaaTT | 35_1 | 749 | -17 |
| 36 | gaaggttatttaattc | 2-11-3 | GAaggttatttaaTTC | 36_1 | 773 | -13 |
| 37 | ctaatcgaatgcagca | 4-9-3 | CTAAtcgaatgcaGCA | 37_1 | 805 | -22 |
| 38 | tacccaatctaatcga | 3-10-3 | TACccaatctaatCGA | 38_1 | 813 | -20 |
| 39 | tagttacccaatctaa | 3-10-3 | TAGttacccaatcTAA | 39_1 | 817 | -19 |
| 40 | catttagttacccaat | 3-10-3 | CATttagttacccAAT | 40_1 | 821 | -18 |
| 41 | tcatttagttacccaa | 3-10-3 | TCAtttagttaccCAA | 41_1 | 822 | -19 |
| 42 | ttcatttagttaccca | 2-10-4 | TTcatttagttaCCCA | 42_1 | 823 | -22 |
| 43 | gaattaatttcatttagt | 4-10-4 | GAATtaatttcattTAGT | 43_1 | 829 | -19 |
| 44 | cagtgaggaattaattt | 4-9-4 | CAGTgaggaattaATTT | 44_1 | 837 | -20 |
| 45 | ccaacagtgaggaatt | 4-8-4 | CCAAcagtgaggAATT | 45_1 | 842 | -21 |
| 46 | cccaacagtgaggaat | 3-10-3 | CCCaacagtgaggAAT | 46_1 | 843 | -22 |
| 47 | tacccaacagtgagg | 2-12-3 | TAcccaacagtgAGG | 47_1 | 846 | -21 |
| 48 | ttatacccaacagtgag | 2-11-4 | TTatacccaacagTGAG | 48_1 | 847 | -21 |
| 49 | tttatacccaacagtga | 3-11-3 | TTTatacccaacagTGA | 49_1 | 848 | -21 |
| 50 | cctttatacccaacag | 3-10-3 | CCTttatacccaaCAG | 50_1 | 851 | -23 |
| 51 | taacctttatacccaa | 4-8-4 | TAACctttatacCCAA | 51_1 | 854 | -22 |

TABLE 5-continued list of oligonucleotide motif sequences (indicated by SEQ ID NO) targeting the human
PD-L1 transcript (SEQ ID NO: 1), designs of these, as well as specific antisense oligonucleotide
compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 52 | aataacctttatacccca | 3-10-4 | AATaacctttataCCCA | 52_1 | 855 | -23 |
| 53 | gtaaataacctttata | 3-11-2 | GTAaataacctttaTA | 53_1 | 859 | -14 |
| 54 | actgtaaataacctttat | 4-10-4 | ACTGtaaataaccttTTAT | 54_1 | 860 | -20 |
| 55 | atatatatgcaatgag | 3-11-2 | ATAtatatgcaatgAG | 55_1 | 903 | -14 |
| 56 | agatatatatgcaatg | 2-12-2 | AGatatatatgcaaTG | 56_1 | 905 | -12 |
| 57 | gagatatatatgcaat | 3-10-3 | GAGatatatatgcAAT | 57_1 | 906 | -15 |
| 58 | ccagagatatatatgc | 2-11-3 | CCagagatatataTGC | 58_1 | 909 | -19 |
| 59 | caatattccagagatat | 4-9-4 | CAATattccagagATAT | 59_1 | 915 | -20 |
| 60 | gcaatattccagagata | 4-10-3 | GCAatattccagagATA | 60_1 | 916 | -22 |
| 61 | agcaatattccagagat | 3-11-3 | AGCaatattccagaGAT | 61_1 | 917 | -22 |
| 62 | cagcaatattccagag | 3-9-4 | CAGcaatattccAGAG | 62_1 | 919 | -22 |
| 63 | aatcagcaatattccag | 4-9-4 | AATCagcaatattCCAG | 63_1 | 921 | -23 |
| 64 | acaatcagcaatattcc | 4-9-4 | ACAAtcagcaataTTCC | 64_1 | 923 | -21 |
| 65 | actaagtagttacacttct | 2-14-3 | ACtaagtagttacactTCT | 65_1 | 957 | -20 |
| 66 | ctaagtagttacacttc | 4-11-2 | CTAAgtagttacactTC | 66_1 | 958 | -18 |
| 67 | gactaagtagttacactt | 3-12-3 | GACtaagtagttacaCTT | 67_1 | 959 | -20 |
| 68 | tgactaagtagttaca | 3-9-4 | TGActaagtagtTACA | 68_1 | 962 | -19 |
| 69 | ctttgactaagtagtta | 4-10-3 | CTTTgactaagtagTTA | 69_1 | 964 | -19 |
| 70 | ctctttgactaagtag | 3-10-3 | CTCtttgactaagTAG | 70_1 | 967 | -19 |
| 71 | gctctttgactaagta | 4-10-2 | GCTCtttgactaagTA | 71_1 | 968 | -21 |
| 72 | ccttaaatactgttgac | 2-11-4 | CCttaaatactgtTGAC | 72_1 | 1060 | -20 |
| 73 | cttaaatactgttgac | 2-12-2 | CTtaaatactgttgAC | 73_1 | 1060 | -13 |
| 74 | tccttaaatactgttg | 3-10-3 | TCCttaaatactgTTG | 74_1 | 1062 | -18 |
| 75 | tctccttaaatactgtt | 4-11-2 | TCTCcttaaatactgTT | 75_1 | 1063 | -19 |
| 76 | tatcatagttctcctt | 2-10-4 | TAtcatagttctCCTT | 76_1 | 1073 | -21 |
| 77 | agtatcatagttctcc | 3-10-3 | AGTatcatagttcTCC | 77_1 | 1075 | -22 |
| 78 | gagtatcatagttctc | 2-11-3 | GAgtatcatagttCTC | 78_1 | 1076 | -18 |
| 79 | agagtatcatagttct | 2-10-4 | AGagtatcatagTTCT | 79_1 | 1077 | -18 |
| 79 | agagtatcatagttct | 3-10-3 | AGAgtatcatagtTCT | 79_2 | 1077 | -19 |
| 80 | cagagtatcatagttc | 3-10-3 | CAGagtatcatagTTC | 80_1 | 1078 | -18 |
| 81 | ttcagagtatcatagt | 4-10-2 | TTCAgagtatcataGT | 81_1 | 1080 | -18 |
| 82 | cttcagagtatcatag | 3-9-4 | CTTcagagtatcATAG | 82_1 | 1081 | -19 |
| 83 | ttcttcagagtatcata | 4-11-2 | TTCTtcagagtatcaTA | 83_1 | 1082 | -19 |
| 84 | tttcttcagagtatcat | 3-10-4 | TTTcttcagagtaTCAT | 84_1 | 1083 | -20 |
| 85 | gagaaaggctaagttt | 4-9-3 | GAGAaaggctaagTTT | 85_1 | 1099 | -19 |
| 86 | gacactcttgtacatt | 2-10-4 | GAcactcttgtaCATT | 86_1 | 1213 | -19 |
| 87 | tgagacactcttgtaca | 2-13-2 | TGagacactcttgtaCA | 87_1 | 1215 | -18 |

TABLE 5-continued list of oligonucleotide motif sequences (indicated by SEQ ID NO) targeting the human
PD-L1 transcript (SEQ ID NO: 1), designs of these, as well as specific antisense oligonucleotide
compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 88 | tgagacactcttgtac | 2-11-3 | TGagacactcttgTAC | 88_1 | 1216 | -18 |
| 89 | ctttattaaactccat | 2-10-4 | CTttattaaactCCAT | 89_1 | 1266 | -18 |
| 90 | accaaactttattaaa | 4-10-2 | ACCAaactttattaAA | 90_1 | 1272 | -14 |
| 91 | aaacctctactaagtg | 4-10-2 | AAACctctactaagTG | 91_1 | 1288 | -16 |
| 92 | agattaagacagttga | 2-11-3 | AGattaagacagtTGA | 92_1 | 1310 | -16 |
| 93 | aagtaggagcaagaggc | 2-12-3 | AAgtaggagcaagaGGC | 93_1 | 1475 | -22 |
| 94 | aaagtaggagcaagagg | 4-10-3 | AAAGtaggagcaagAGG | 94_1 | 1476 | -20 |
| 95 | gttaagcagccaggag | 2-12-2 | GTtaagcagccaggAG | 95_1 | 1806 | -20 |
| 96 | agggtaggatgggtag | 2-12-2 | AGggtaggatgggtAG | 96_1 | 1842 | -20 |
| 97 | aagggtaggatgggta | 3-11-2 | AAGggtaggatgggTA | 97_1 | 1843 | -20 |
| 98 | caagggtaggatgggt | 2-12-2 | CAagggtaggatggGT | 98_2 | 1844 | -20 |
| 98 | caagggtaggatgggt | 3-11-2 | CAAgggtaggatggGT | 98_1 | 1844 | -21 |
| 99 | ccaagggtaggatggg | 2-12-2 | CCaagggtaggatgGG | 99_1 | 1845 | -22 |
| 100 | tccaagggtaggatgg | 2-12-2 | TCcaagggtaggatGG | 100_1 | 1846 | -20 |
| 101 | cttccaagggtaggat | 4-10-2 | CTTCcaagggtaggAT | 101_1 | 1848 | -21 |
| 102 | atcttccaagggtagga | 3-12-2 | ATCttccaagggtagGA | 102_1 | 1849 | -22 |
| 103 | agaagtgatggctcatt | 2-11-4 | AGaagtgatggctCATT | 103_1 | 1936 | -21 |
| 104 | aagaagtgatggctcat | 3-10-4 | AAGaagtgatggcTCAT | 104_1 | 1937 | -21 |
| 105 | gaagaagtgatggctca | 3-11-3 | GAAgaagtgatggcTCA | 105_1 | 1938 | -21 |
| 106 | atgaaatgtaaactggg | 4-9-4 | ATGAaatgtaaacTGGG | 106_1 | 1955 | -21 |
| 107 | caatgaaatgtaaactgg | 4-10-4 | CAATgaaatgtaaaCTGG | 107_1 | 1956 | -20 |
| 108 | gcaatgaaatgtaaactg | 4-10-4 | GCAAtgaaatgtaaACTG | 108_1 | 1957 | -20 |
| 109 | agcaatgaaatgtaaact | 4-10-4 | AGCAatgaaatgtaAACT | 109_1 | 1958 | -20 |
| 110 | gagcaatgaaatgtaaac | 4-10-4 | GAGCaatgaaatgtAAAC | 110_1 | 1959 | -19 |
| 111 | tgaattcccatatccga | 2-12-3 | TGaattcccatatcCGA | 111_1 | 1992 | -22 |
| 112 | agaattatgaccatat | 2-11-3 | AGaattatgaccaTAT | 112_1 | 2010 | -15 |
| 113 | aggtaagaattatgacc | 3-10-4 | AGGtaagaattatGACC | 113_1 | 2014 | -21 |
| 114 | tcaggtaagaattatgac | 4-10-4 | TCAGgtaagaattaTGAC | 114_1 | 2015 | -22 |
| 115 | cttcaggtaagaattatg | 4-10-4 | CTTCaggtaagaatTATG | 115_1 | 2017 | -21 |
| 116 | tcttcaggtaagaatta | 4-9-4 | TCTTcaggtaagaATTA | 116_1 | 2019 | -20 |
| 117 | cttcttcaggtaagaat | 4-9-4 | CTTCttcaggtaaGAAT | 117_1 | 2021 | -21 |
| 118 | tcttcttcaggtaagaa | 4-10-3 | TCTTcttcaggtaaGAA | 118_1 | 2022 | -20 |
| 119 | tcttcttcaggtaaga | 3-10-3 | TCTtcttcaggtaAGA | 119_1 | 2023 | -20 |
| 120 | tggtctaagagaagaag | 3-10-4 | TGGtctaagagaaGAAG | 120_1 | 2046 | -20 |
| 121 | gttggtctaagagaag | 4-9-3 | GTTGgtctaagagAAG | 121_1 | 2049 | -19 |
| 123 | cagttggtctaagagaa | 2-11-4 | CAgttggtctaagAGAA | 123_1 | 2050 | -20 |

TABLE 5-continued list of oligonucleotide motif sequences (indicated by SEQ ID NO) targeting the human
PD-L1 transcript (SEQ ID NO: 1), designs of these, as well as specific antisense oligonucleotide
compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 124 | gcagttggtctaagagaa | 3-13-2 | GCAgttggtctaagagAA | 124_1 | 2050 | -22 |
| 122 | agttggtctaagagaa | 3-9-4 | AGTtggtctaagAGAA | 122_1 | 2050 | -20 |
| 126 | gcagttggtctaagaga | 2-13-2 | GCagttggtctaagaGA | 126_1 | 2051 | -21 |
| 125 | cagttggtctaagaga | 4-10-2 | CAGTtggtctaagaGA | 125_1 | 2051 | -21 |
| 127 | gcagttggtctaagag | 2-11-3 | GCagttggtctaaGAG | 127_1 | 2052 | -21 |
| 128 | ctcatatcagggcagt | 2-10-4 | CTcatatcagggCAGT | 128_1 | 2063 | -24 |
| 129 | cacacatgttctttaac | 4-11-2 | CACAcatgttctttaAC | 129_1 | 2087 | -18 |
| 130 | taaatacacacatgttct | 3-11-4 | TAAatacacacatgTTCT | 130_1 | 2092 | -19 |
| 131 | gtaaatacacacatgttc | 4-11-3 | GTAAatacacacatgTTC | 131_1 | 2093 | -19 |
| 132 | tgtaaatacacacatgtt | 4-10-4 | TGTAaatacacacaTGTT | 132_1 | 2094 | -22 |
| 133 | gatcatgtaaatacacac | 4-10-4 | GATCatgtaaatacACAC | 133_1 | 2099 | -20 |
| 134 | agatcatgtaaatacaca | 4-10-4 | AGATcatgtaaataCACA | 134_1 | 2100 | -21 |
| 135 | caaagatcatgtaaatacac | 4-12-4 | CAAAgatcatgtaaatACAC | 135_1 | 2101 | -19 |
| 136 | acaaagatcatgtaaataca | 4-12-4 | ACAAagatcatgtaaaTACA | 136_1 | 2102 | -20 |
| 137 | gaatacaaagatcatgta | 4-10-4 | GAATacaaagatcaTGTA | 137_1 | 2108 | -20 |
| 138 | agaatacaaagatcatgt | 4-10-4 | AGAAtacaaagatcATGT | 138_1 | 2109 | -20 |
| 139 | cagaatacaaagatcatg | 4-10-4 | CAGAatacaaagatCATG | 139_1 | 2110 | -21 |
| 140 | gcagaatacaaagatca | 4-9-4 | GCAGaatacaaagATCA | 140_1 | 2112 | -22 |
| 141 | aggcagaatacaaagat | 4-11-2 | AGGCagaatacaaagAT | 141_1 | 2114 | -19 |
| 142 | aaggcagaatacaaaga | 4-10-3 | AAGGcagaatacaaAGA | 142_1 | 2115 | -19 |
| 143 | attagtgagggacgaa | 3-10-3 | ATTagtgagggacGAA | 143_1 | 2132 | -18 |
| 144 | cattagtgagggacga | 2-11-3 | CAttagtgagggaCGA | 144_1 | 2133 | -20 |
| 145 | gagggtgatggattag | 2-11-3 | GAgggtgatggatTAG | 145_1 | 2218 | -19 |
| 146 | ttaggagtaataaagg | 2-10-4 | TTaggagtaataAAGG | 146_1 | 2241 | -14 |
| 147 | ttaatgaatttggttg | 3-11-2 | TTAatgaatttggtTG | 147_1 | 2263 | -13 |
| 148 | ctttaatgaatttggt | 2-12-2 | CTttaatgaatttgGT | 148_1 | 2265 | -14 |
| 149 | catggattacaactaa | 4-10-2 | CATGgattacaactAA | 149_1 | 2322 | -16 |
| 150 | tcatggattacaacta | 2-11-3 | TCatggattacaaCTA | 150_1 | 2323 | -16 |
| 151 | gtcatggattacaact | 3-11-2 | GTCatggattacaaCT | 151_1 | 2324 | -18 |
| 152 | cattaaatctagtcat | 2-10-4 | CAttaaatctagTCAT | 152_1 | 2335 | -16 |
| 153 | gacattaaatctagtca | 4-10-3 | GACattaaatctagTCA | 153_1 | 2336 | -19 |
| 154 | agggacattaaatcta | 4-10-2 | AGGGacattaaatcTA | 154_1 | 2340 | -18 |
| 155 | caaagcattataacca | 4-9-3 | CAAAgcattataaCCA | 155_1 | 2372 | -18 |
| 156 | acttactaggcagaag | 2-10-4 | ACttactaggcaGAAG | 156_1 | 2415 | -19 |
| 157 | cagagttaactgtaca | 4-10-2 | CAGagttaactgtaCA | 157_1 | 2545 | -20 |
| 158 | ccagagttaactgtac | 4-10-2 | CCAgagttaactgtAC | 158_1 | 2546 | -20 |
| 159 | gccagagttaactgta | 2-12-2 | GCcagagttaactgTA | 159_1 | 2547 | -20 |

TABLE 5-continued list of oligonucleotide motif sequences (indicated by SEQ ID NO) targeting the human
PD-L1 transcript (SEQ ID NO: 1), designs of these, as well as specific antisense oligonucleotide
compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 160 | tgggccagagttaact | 2-12-2 | TGggccagagttaaCT | 160_1 | 2550 | -21 |
| 161 | cagcatctatcagact | 2-12-2 | CAgcatctatcagaCT | 161_1 | 2576 | -19 |
| 162 | tgaaataacatgagtcat | 3-11-4 | TGAaataacatgagTCAT | 162_1 | 2711 | -19 |
| 163 | gtgaaataacatgagtc | 3-10-4 | GTGaaataacatgAGTC | 163_1 | 2713 | -19 |
| 164 | tctgtttatgtcactg | 4-10-2 | TCTGtttatgtcacTG | 164_1 | 2781 | -20 |
| 165 | gtctgtttatgtcact | 4-10-2 | GTCTgtttatgtcaCT | 165_1 | 2782 | -22 |
| 166 | tggtctgtttatgtca | 2-10-4 | TGgtctgtttatGTCA | 166_1 | 2784 | -21 |
| 167 | ttggtctgtttatgtc | 4-10-2 | TTGGtctgtttatGTC | 167_1 | 2785 | -20 |
| 168 | tcacccattgtttaaa | 2-12-2 | TCacccattgtttaAA | 168_1 | 2842 | -15 |
| 169 | ttcagcaaatattcgt | 2-10-4 | TTcagcaaatatTCGT | 169_1 | 2995 | -17 |
| 170 | gtgtgttcagcaaatat | 3-10-4 | GTGtgttcagcaaATAT | 170_1 | 2999 | -21 |
| 171 | tctattgttaggtatc | 3-10-3 | TCTattgttaggtATC | 171_1 | 3053 | -18 |
| 172 | attgcccatcttactg | 2-12-2 | ATtgcccatcttacTG | 172_1 | 3118 | -19 |
| 173 | tattgcccatcttact | 3-11-2 | TATtgcccatcttaCT | 173_1 | 3119 | -21 |
| 174 | aaatattgcccatctt | 2-11-3 | AAatattgcccatCTT | 174_1 | 3122 | -17 |
| 175 | ataaccttatcataca | 3-11-2 | ATAaccttatcataCA | 175_1 | 3174 | -16 |
| 176 | tataaccttatcatac | 2-11-3 | TAtaaccttatcaTAC | 176_1 | 3175 | -14 |
| 177 | ttataaccttatcata | 3-11-2 | TTAtaaccttatcaTA | 177_1 | 3176 | -14 |
| 178 | tttataaccttatcat | 3-10-3 | TTTataaccttatCAT | 178_1 | 3177 | -16 |
| 179 | actgctattgctatct | 2-11-3 | ACtgctattgctaTCT | 179_1 | 3375 | -19 |
| 180 | aggactgctattgcta | 2-11-3 | AGgactgctattgCTA | 180_1 | 3378 | -21 |
| 181 | gaggactgctattgct | 3-11-2 | GAGgactgctattgCT | 181_1 | 3379 | -22 |
| 182 | acgtagaataataaca | 2-12-2 | ACgtagaataataaCA | 182_1 | 3561 | -11 |
| 183 | ccaagtgatataatgg | 2-10-4 | CCaagtgatataATGG | 183_1 | 3613 | -19 |
| 184 | ttagcagaccaagtga | 2-10-4 | TTagcagaccaaGTGA | 184_1 | 3621 | -21 |
| 185 | gtttagcagaccaagt | 2-12-2 | GTttagcagaccaaGT | 185_1 | 3623 | -19 |
| 186 | tgacagtgattatatt | 2-12-2 | TGacagtgattataTT | 186_1 | 3856 | -13 |
| 187 | tgtccaagatattgac | 4-10-2 | TGTCcaagatattgAC | 187_1 | 3868 | -18 |
| 188 | gaatatcctagattgt | 3-10-3 | GAAtatcctagatTGT | 188_1 | 4066 | -18 |
| 189 | caaactgagaatatcc | 2-11-3 | CAaactgagaataTCC | 189_1 | 4074 | -16 |
| 190 | gcaaactgagaatatc | 3-11-2 | GCAaactgagaataTC | 190_1 | 4075 | -16 |
| 191 | tcctattacaatcgta | 3-11-2 | TCCtattacaatcgTA | 191_1 | 4214 | -19 |
| 192 | ttcctattacaatcgt | 4-10-2 | TTCCtattacaatcGT | 192_1 | 4215 | -19 |
| 193 | actaatgggaggattt | 2-12-2 | ACtaatgggaggatTT | 193_1 | 4256 | -15 |
| 194 | tagttcagagaataag | 2-12-2 | TAgttcagagaataAG | 194_1 | 4429 | -13 |
| 195 | taacatatagttcaga | 2-11-3 | TAacatatagttcAGA | 195_1 | 4436 | -15 |

TABLE 5-continued list of oligonucleotide motif sequences (indicated by SEQ ID NO) targeting the human
PD-L1 transcript (SEQ ID NO: 1), designs of these, as well as specific antisense oligonucleotide
compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 196 | ataacatatagttcag | 3-11-2 | ATAacatatagttcAG | 196_1 | 4437 | −14 |
| 197 | cataacatatagttca | 2-12-2 | CAtaacatatagttCA | 197_1 | 4438 | −13 |
| 198 | tcataacatatagttc | 2-12-2 | TCataacatatagtTC | 198_1 | 4439 | −12 |
| 199 | tagctcctaacaatca | 4-10-2 | TAGCtcctaacaatCA | 199_1 | 4507 | −22 |
| 200 | ctccaatctttgtata | 4-10-2 | CTCCaatctttgtaTA | 200_1 | 4602 | −20 |
| 201 | tctccaatctttgtat | 4-10-2 | TCTCcaatctttgtAT | 201_1 | 4603 | −19 |
| 202 | tctatttcagccaatc | 2-12-2 | TCtatttcagccaaTC | 202_1 | 4708 | −17 |
| 203 | cggaagtcagagtgaa | 3-10-3 | CGGaagtcagagtGAA | 203_1 | 4782 | −19 |
| 204 | ttaagcatgaggaata | 4-10-2 | TTAAgcatgaggaaTA | 204_1 | 4798 | −16 |
| 205 | tgattgagcacctctt | 3-10-3 | TGAttgagcacctCTT | 205_1 | 4831 | −22 |
| 206 | gactaattatttcgtt | 3-11-2 | GACtaattatttcgTT | 206_1 | 4857 | −15 |
| 207 | tgactaattatttcgt | 3-10-3 | TGActaattatttCGT | 207_1 | 4858 | −17 |
| 208 | gtgactaattatttcg | 3-10-3 | GTGactaattattTCG | 208_1 | 4859 | −17 |
| 209 | ctgcttgaaatgtgac | 4-10-2 | CTGCttgaaatgtgAC | 209_1 | 4870 | −20 |
| 210 | cctgcttgaaatgtga | 2-11-3 | CCtgcttgaaatgTGA | 210_1 | 4871 | −21 |
| 211 | atcctgcttgaaatgt | 2-10-4 | ATcctgcttgaaATGT | 211_1 | 4873 | −20 |
| 212 | attataaatctattct | 3-10-3 | ATTataaatctatTCT | 212_1 | 5027 | −13 |
| 213 | gctaaatactttcatc | 2-11-3 | GCtaaatactttcATC | 213_1 | 5151 | −16 |
| 214 | cattgtaacataccta | 2-10-4 | CAttgtaacataCCTA | 214_1 | 5251 | −19 |
| 215 | gcattgtaacatacct | 2-12-2 | GCattgtaacatacCT | 215_1 | 5252 | −18 |
| 216 | taatattgcaccaaat | 2-12-2 | TAatattgcaccaaAT | 216_1 | 5295 | −13 |
| 217 | gataatattgcaccaa | 2-11-3 | GAtaatattgcacCAA | 217_1 | 5297 | −16 |
| 218 | agataatattgcacca | 2-12-2 | AGataatattgcacCA | 218_1 | 5298 | −16 |
| 219 | gccaagaagataatat | 2-10-4 | GCcaagaagataATAT | 219_1 | 5305 | −17 |
| 220 | cacagccacataaact | 4-10-2 | CACAgccacataaaCT | 220_1 | 5406 | −21 |
| 221 | ttgtaattgtggaaac | 2-12-2 | TTgtaattgtggaaAC | 221_1 | 5463 | −12 |
| 222 | tgacttgtaattgtgg | 2-11-3 | TGacttgtaattgTGG | 222_1 | 5467 | −18 |
| 223 | tctaactgaaatagtc | 2-12-2 | TCtaactgaaatagTC | 223_1 | 5503 | −13 |
| 224 | gtggttctaactgaaa | 3-11-2 | GTGgttctaactgaAA | 224_1 | 5508 | −16 |
| 225 | caatatgggacttggt | 2-12-2 | CAatatgggacttgGT | 225_1 | 5522 | −18 |
| 226 | atgacaatatgggact | 3-11-2 | ATGacaatatgggaCT | 226_1 | 5526 | −17 |
| 227 | tatgacaatatgggac | 4-10-2 | TATGacaatatgggAC | 227_1 | 5527 | −17 |
| 228 | atatgacaatatggga | 4-10-2 | ATATgacaatatggGA | 228_1 | 5528 | −17 |
| 229 | cttcacttaataatta | 2-11-3 | CTtcacttaataaTTA | 229_1 | 5552 | −13 |
| 230 | ctgcttcacttaataa | 4-10-2 | CTGCttcacttaatAA | 230_1 | 5555 | −18 |
| 231 | aagactgcttcactta | 2-11-3 | AAgactgcttcacTTA | 231_1 | 5559 | −17 |
| 232 | gaatgccctaattatg | 4-10-2 | GAATgccctaattaTG | 232_1 | 5589 | −19 |

TABLE 5-continued list of oligonucleotide motif sequences (indicated by SEQ ID NO) targeting the human
PD-L1 transcript (SEQ ID NO: 1), designs of these, as well as specific antisense oligonucleotide
compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 233 | tggaatgccctaatta | 3-11-2 | TGGaatgccctaatTA | 233_1 | 5591 | -19 |
| 234 | gcaaatgccagtaggt | 3-11-2 | GCAaatgccagtagGT | 234_1 | 5642 | -23 |
| 235 | ctaatggaaggatttg | 3-11-2 | CTAatggaaggattTG | 235_1 | 5673 | -15 |
| 236 | aatatagaacctaatg | 2-12-2 | AAtatagaacctaaTG | 236_1 | 5683 | -10 |
| 237 | gaaagaatagaatgtt | 3-10-3 | GAAagaatagaatGTT | 237_1 | 5769 | -12 |
| 238 | atgggtaatagattat | 3-11-2 | ATGggtaatagattAT | 238_1 | 5893 | -15 |
| 239 | gaaagagcacagggtg | 2-12-2 | GAaagagcacagggTG | 239_1 | 6103 | -18 |
| 240 | ctacatagagggaatg | 4-10-2 | CTACatagagggaaTG | 240_1 | 6202 | -18 |
| 241 | gcttcctacatagagg | 2-10-4 | GCttcctacataGAGG | 241_1 | 6207 | -24 |
| 242 | tgcttcctacatagag | 4-10-2 | TGCTtcctacatagAG | 242_1 | 6208 | -22 |
| 243 | tgggcttgaaatatgt | 2-11-3 | TGggcttgaaataTGT | 243_1 | 6417 | -19 |
| 244 | cattatatttaagaac | 3-11-2 | CATtatatttaagaAC | 244_1 | 6457 | -11 |
| 245 | tcggttatgttatcat | 2-10-4 | TCggttatgttaTCAT | 245_1 | 6470 | -19 |
| 246 | cactttatctggtcgg | 2-10-4 | CActttatctggTCGG | 246_1 | 6482 | -22 |
| 247 | aaattggcacagcgtt | 3-10-3 | AAAttggcacagcGTT | 247_1 | 6505 | -18 |
| 248 | accgtgacagtaaatg | 4-9-3 | ACCGtgacagtaaATG | 248_1 | 6577 | -20 |
| 249 | tgggaaccgtgacagta | 2-13-2 | TGggaaccgtgacagTA | 249_1 | 6581 | -22 |
| 250 | ccacatataggtcctt | 2-11-3 | CCacatataggtcCTT | 250_1 | 6597 | -21 |
| 251 | catattgctaccatac | 2-11-3 | CAtattgctaccaTAC | 251_1 | 6617 | -18 |
| 252 | tcatattgctaccata | 3-10-3 | TCAtattgctaccATA | 252_1 | 6618 | -19 |
| 253 | caattgtcatattgct | 4-8-4 | CAATtgtcatatTGCT | 253_1 | 6624 | -21 |
| 254 | cattcaattgtcatattg | 3-12-3 | CATcaattgtcataTTG | 254_1 | 6626 | -18 |
| 255 | tttctactgggaatttg | 4-9-4 | TTTCtactgggaaTTTG | 255_1 | 6644 | -20 |
| 256 | caattagtgcagccag | 3-10-3 | CAAttagtgcagcCAG | 256_1 | 6672 | -21 |
| 257 | gaataatgttcttatcc | 4-10-3 | GAATaatgttcttaTCC | 257_1 | 6704 | -20 |
| 258 | cacaaattgaataatgttct | 4-13-3 | CACAaattgaataatgtTCT | 258_1 | 6709 | -20 |
| 259 | catgcacaaattgaataat | 4-11-4 | CATGcacaaattgaaTAAT | 259_1 | 6714 | -20 |
| 260 | atcctgcaatttcacat | 3-11-3 | ATCctgcaatttcaCAT | 260_1 | 6832 | -22 |
| 261 | ccaccatagctgatca | 2-12-2 | CCaccatagctgatCA | 261_1 | 6868 | -22 |
| 262 | accaccatagctgatca | 2-12-3 | ACcaccatagctgaTCA | 262_1 | 6868 | -23 |
| 263 | caccaccatagctgatc | 2-13-2 | CAccaccatagctgaTC | 263_1 | 6869 | -21 |
| 264 | tagtcggcaccaccat | 2-12-2 | TAgtcggcaccaccAT | 264_1 | 6877 | -22 |
| 265 | cttgtagtcggcaccac | 1-14-2 | Cttgtagtcggcaccac | 265_1 | 6880 | -21 |
| 266 | cttgtagtcggcacca | 1-13-2 | Cttgtagtcggcacca | 266_1 | 6881 | -21 |
| 267 | cgcttgtagtcggcac | 2-12-2 | CGcttgtagtcggcAC | 267_1 | 6883 | -21 |
| 268 | tcaataaagatcaggc | 3-11-2 | TCAataaagatcagGC | 268_1 | 6942 | -17 |

TABLE 5-continued list of oligonucleotide motif sequences (indicated by SEQ ID NO) targeting the human
PD-L1 transcript (SEQ ID NO: 1), designs of these, as well as specific antisense oligonucleotide
compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 269 | tggacttacaagaatg | 2-12-2 | TGgacttacaagaaTG | 269_1 | 6986 | -14 |
| 270 | atggacttacaagaat | 3-11-2 | ATGgacttacaagaAT | 270_1 | 6987 | -15 |
| 271 | gctcaagaaattggat | 4-10-2 | GCTCaagaaattggAT | 271_1 | 7073 | -19 |
| 272 | tactgtagaacatggc | 4-10-2 | TACTgtagaacatgGC | 272_1 | 7133 | -21 |
| 273 | gcaattcatttgatct | 4-9-3 | GCAAttcatttgaTCT | 273_1 | 7239 | -20 |
| 274 | tgaagggaggagggacac | 2-14-2 | TGaagggaggagggacAC | 274_1 | 7259 | -20 |
| 275 | agtggtgaagggaggag | 2-13-2 | AGtggtgaagggaggAG | 275_1 | 7265 | -21 |
| 276 | tagtggtgaagggaggag | 2-14-2 | TAgtggtgaagggaggAG | 276_1 | 7265 | -21 |
| 277 | atagtggtgaagggaggag | 1-16-2 | Atagtggtgaagggaggag | 277_1 | 7265 | -20 |
| 278 | tagtggtgaagggagga | 2-13-2 | TAgtggtgaagggagGA | 278_1 | 7266 | -21 |
| 279 | atagtggtgaagggagga | 2-14-2 | ATagtggtgaagggagGA | 279_1 | 7266 | -21 |
| 280 | tagtggtgaagggagg | 3-11-2 | TAGtggtgaagggaGG | 280_1 | 7267 | -21 |
| 281 | atagtggtgaagggagg | 3-12-2 | ATAgtggtgaagggaGG | 281_1 | 7267 | -22 |
| 282 | gatagtggtgaagggagg | 2-14-2 | GAtagtggtgaagggaGG | 282_1 | 7267 | -21 |
| 283 | atagtggtgaagggag | 4-10-2 | ATAGtggtgaagggAG | 283_1 | 7268 | -20 |
| 284 | gatagtggtgaagggag | 2-12-3 | GAtagtggtgaaggGAG | 284_1 | 7268 | -21 |
| 285 | gagatagtggtgaagg | 2-10-4 | GAgatagtggtgAAGG | 285_1 | 7271 | -20 |
| 286 | catgggagatagtggt | 4-10-2 | CATGggagatagtgGT | 286_1 | 7276 | -22 |
| 287 | acaaataatggttactct | 4-10-4 | ACAAataatggttaCTCT | 287_1 | 7302 | -20 |
| 288 | acacacaaataatggtta | 4-10-4 | ACACacaaataatgGTTA | 288_1 | 7306 | -20 |
| 289 | gagggacacacaaataat | 3-11-4 | GAGggacacacaaaTAAT | 289_1 | 7311 | -21 |
| 290 | atatagagaggctcaa | 4-8-4 | ATATagagaggcTCAA | 290_1 | 7390 | -21 |
| 291 | ttgatatagagaggct | 2-10-4 | TTgatatagagaGGCT | 291_1 | 7393 | -20 |
| 292 | gcatttgatatagaga | 4-9-3 | GCATttgatatagAGA | 292_1 | 7397 | -20 |
| 293 | tttgcatttgatatag | 2-11-3 | TTtgcatttgataTAG | 293_1 | 7400 | -15 |
| 294 | ctggaagaataggttc | 3-11-2 | CTGgaagaataggtTC | 294_1 | 7512 | -17 |
| 295 | actggaagaataggtt | 4-10-2 | ACTGgaagaataggTT | 295_1 | 7513 | -18 |
| 296 | tactggaagaataggt | 4-10-2 | TACTggaagaatagGT | 296_1 | 7514 | -18 |
| 297 | tggcttatcctgtact | 4-10-2 | TGGCttatcctgtaCT | 297_1 | 7526 | -25 |
| 298 | atggcttatcctgtac | 2-10-4 | ATggcttatcctGTAC | 298_1 | 7527 | -22 |
| 299 | tatggcttatcctgta | 4-10-2 | TATGgcttatcctgTA | 299_1 | 7528 | -22 |
| 300 | gtatggcttatcctgt | 3-10-3 | GTAtggcttatccTGT | 300_1 | 7529 | -23 |
| 301 | atgaatatatgcccagt | 2-11-4 | ATgaatatatgccCAGT | 301_1 | 7547 | -22 |
| 302 | gatgaatatatgccca | 2-10-4 | GAtgaatatatgCCCA | 302_1 | 7549 | -22 |
| 303 | caagatgaatatatgcc | 3-10-4 | CAAgatgaatataTGCC | 303_1 | 7551 | -21 |
| 304 | gacaacatcagtataga | 4-9-4 | GACaacatcagtaTAGA | 304_1 | 7572 | -22 |
| 305 | caagacaacatcagta | 4-8-4 | CAAGacaacatcAGTA | 305_1 | 7576 | -20 |

TABLE 5-continued list of oligonucleotide motif sequences (indicated by SEQ ID NO) targeting the human
PD-L1 transcript (SEQ ID NO: 1), designs of these, as well as specific antisense oligonucleotide
compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 306 | cactcctagttccttt | 3-10-3 | CACtcctagttccTTT | 306_1 | 7601 | -22 |
| 307 | aacactcctagttcct | 3-10-3 | AACactcctagttCCT | 307_1 | 7603 | -22 |
| 308 | taacactcctagttcc | 2-11-3 | TAacactcctagtTCC | 308_1 | 7604 | -20 |
| 309 | ctaacactcctagttc | 2-12-2 | CTaacactcctagtTC | 309_1 | 7605 | -18 |
| 310 | tgataacataactgtg | 2-12-2 | TGataacataactgTG | 310_1 | 7637 | -13 |
| 311 | ctgataacataactgt | 2-10-4 | CTgataacataaCTGT | 311_1 | 7638 | -18 |
| 312 | tttgaactcaagtgac | 4-10-2 | TTTGaactcaagtgAC | 312_1 | 7654 | -16 |
| 313 | tcctttacttagctag | 4-9-3 | TCCTttacttagcTAG | 313_1 | 7684 | -23 |
| 314 | gagtttggattagctg | 2-11-3 | GAgtttggattagCTG | 314_1 | 7764 | -20 |
| 315 | tgggatatgacaggga | 2-11-3 | TGggatatgacagGGA | 315_1 | 7838 | -21 |
| 316 | tgtgggatatgacagg | 4-10-2 | TGTGggatatgacaGG | 316_1 | 7840 | -22 |
| 317 | atatggaagggatatc | 4-10-2 | ATATggaagggataTC | 317_1 | 7875 | -17 |
| 318 | acaggatatggaaggg | 3-10-3 | ACAggatatggaaGGG | 318_1 | 7880 | -21 |
| 319 | atttcaacaggatatgg | 4-9-4 | ATTTcaacaggatATGG | 319_1 | 7885 | -20 |
| 320 | gagtaatttcaacagg | 2-11-3 | GAgtaatttcaacAGG | 320_1 | 7891 | -17 |
| 321 | agggagtaatttcaaca | 4-9-4 | AGGGagtaatttcAACA | 321_1 | 7893 | -22 |
| 322 | attagggagtaattca | 4-9-4 | ATTAgggagtaatTTCA | 322_1 | 7896 | -21 |
| 323 | cttactattagggagt | 2-10-4 | CTtactattaggGAGT | 323_1 | 7903 | -20 |
| 324 | cagcttactattaggg | 2-11-3 | CAgcttactattaGGG | 324_1 | 7906 | -20 |
| 326 | atttcagcttactattag | 3-11-4 | ATTtcagcttactaTTAG | 326_1 | 7908 | -20 |
| 325 | tcagcttactattagg | 3-10-3 | TCAgcttactattAGG | 325_1 | 7907 | -20 |
| 327 | ttcagcttactattag | 2-10-4 | TTcagcttactaTTAG | 327_1 | 7908 | -17 |
| 328 | cagatttcagcttact | 4-10-2 | CAGAtttcagcttaCT | 328_1 | 7913 | -21 |
| 329 | gactacaactagaggg | 3-11-2 | GACtacaactagagGG | 329_1 | 7930 | -19 |
| 330 | agactacaactagagg | 4-10-2 | AGACtacaactagaGG | 330_1 | 7931 | -19 |
| 331 | aagactacaactagag | 2-12-2 | AAgactacaactagAG | 331_1 | 7932 | -13 |
| 332 | atgatttaattctagtcaaa | 4-12-4 | ATGAtttaattctagtCAAA | 332_1 | 7982 | -20 |
| 333 | tttaattctagtcaaa | 3-10-3 | TTTaattctagtcAAA | 333_1 | 7982 | -12 |
| 334 | gatttaattctagtca | 4-8-4 | GATTtaattctaGTCA | 334_1 | 7984 | -20 |
| 771 | tgatttaattctagtca | 3-10-4 | TGAtttaattctaGTCA | 771_1 | 7984 | -20 |
| 335 | atgatttaattctagtca | 4-11-3 | ATGAtttaattctagTCA | 335_1 | 7984 | -20 |
| 336 | gatgatttaattctagtca | 4-13-2 | GATGatttaattctagtCA | 336_1 | 7984 | -20 |
| 337 | gatttaattctagtca | 2-10-4 | GAtttaattctaGTCA | 337_1 | 7984 | -18 |
| 338 | gatgatttaattctagtc | 4-11-3 | GATGatttaattctaGTC | 338_1 | 7985 | -20 |
| 339 | tgatttaattctagtc | 2-12-2 | TGatttaattctagTC | 339_1 | 7985 | -13 |
| 340 | gagatgatttaattcta | 4-9-4 | GAGAtgatttaatTCTA | 340_1 | 7988 | -20 |

TABLE 5-continued list of oligonucleotide motif sequences (indicated by SEQ ID NO) targeting the human PD-L1 transcript (SEQ ID NO: 1), designs of these, as well as specific antisense oligonucleotide compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 341 | gagatgatttaattct | 3-10-3 | GAGatgatttaatTCT | 341_1 | 7989 | -16 |
| 342 | cagattgatggtagtt | 4-10-2 | CAGAttgatggtagTT | 342_1 | 8030 | -19 |
| 343 | ctcagattgatggtag | 2-10-4 | CTcagattgatgGTAG | 343_1 | 8032 | -20 |
| 344 | gttagccctcagattg | 3-10-3 | GTTagccctcagaTTG | 344_1 | 8039 | -23 |
| 345 | tgtattgttagccctc | 2-10-4 | TGtattgttagcCCTC | 345_1 | 8045 | -24 |
| 346 | acttgtattgttagcc | 2-10-4 | ACttgtattgttAGCC | 346_1 | 8048 | -22 |
| 347 | agccagtatcagggac | 3-11-2 | AGCcagtatcagggAC | 347_1 | 8191 | -23 |
| 348 | ttgacaatagtggcat | 2-10-4 | TTgacaatagtgGCAT | 348_1 | 8213 | -20 |
| 349 | acaagtggtatcttct | 3-10-3 | ACAagtggtatctTCT | 349_1 | 8228 | -19 |
| 350 | aatctactttacaagt | 4-10-2 | AATCtactttacaaGT | 350_1 | 8238 | -16 |
| 351 | cacagtagatgcctgata | 2-12-4 | CAcagtagatgcctGATA | 351_1 | 8351 | -24 |
| 352 | gaacacagtagatgcc | 2-11-3 | GAacacagtagatGCC | 352_1 | 8356 | -21 |
| 353 | cttggaacacagtagat | 4-11-2 | CTTGgaacacagtagAT | 353_1 | 8359 | -20 |
| 354 | atatcttggaacacag | 3-10-3 | ATAtcttggaacaCAG | 354_1 | 8364 | -18 |
| 355 | tctttaatatcttggaac | 3-11-4 | TCTttaatatcttGAAC | 355_1 | 8368 | -19 |
| 356 | tgatttctttaatatcttg | 2-13-4 | TGatttctttaatatCTTG | 356_1 | 8372 | -19 |
| 357 | tgatgatttctttaatatc | 2-13-4 | TGatgatttctttaaTATC | 357_1 | 8375 | -18 |
| 358 | aggctaagtcatgatg | 3-11-2 | AGGctaagtcatgaTG | 358_1 | 8389 | -19 |
| 359 | ttgatgaggctaagtc | 4-10-2 | TTGatgaggctaagTC | 359_1 | 8395 | -19 |
| 360 | ccaggattatactctt | 3-11-2 | CCAggattatactcTT | 360_1 | 8439 | -20 |
| 361 | gccaggattatactct | 2-10-4 | GCcaggattataCTCT | 361_1 | 8440 | -23 |
| 362 | ctgccaggattatact | 3-11-2 | CTGccaggattataCT | 362_1 | 8442 | -21 |
| 363 | cagaaacttatactttatg | 4-13-2 | CAGAaacttatactttaTG | 363_1 | 8473 | -19 |
| 364 | aagcagaaacttatact | 4-9-4 | AAGCagaaactta TACT | 364_1 | 8478 | -20 |
| 365 | gaagcagaaacttatact | 3-11-4 | GAAgcagaaacttaTACT | 365_1 | 8478 | -20 |
| 366 | tggaagcagaaacttatact | 3-15-2 | TGGaagcagaaacttataCT | 366_1 | 8478 | -21 |
| 367 | tggaagcagaaacttatac | 3-13-3 | TGGaagcagaaacttaTAC | 367_1 | 8479 | -20 |
| 368 | aagcagaaacttatac | 2-11-3 | AAgcagaaacttaTAC | 368_1 | 8479 | -13 |
| 369 | tggaagcagaaacttata | 3-11-4 | TGGaagcagaaactTATA | 369_1 | 8480 | -21 |
| 370 | aagggatattatggag | 4-10-2 | AAGGgatattatggAG | 370_1 | 8587 | -18 |
| 371 | tgccggaagatttcct | 2-12-2 | TGccggaagatttcCT | 371_1 | 8641 | -21 |
| 372 | atggattgggagtaga | 4-10-2 | ATGGattgggagtaGA | 372_1 | 8772 | -21 |
| 373 | agatggattgggagta | 2-12-2 | AGatggattgggagTA | 373_1 | 8774 | -18 |
| 374 | aagatggattgggagt | 3-11-2 | AAGatggattgggaGT | 374_1 | 8775 | -18 |
| 375 | acaagatggattggga | 2-10-4 | ACaagatggattGGGA | 375_1 | 8777 | -20 |
| 375 | acaagatggattggga | 2-12-2 | ACaagatggattggGA | 375_2 | 8777 | -17 |
| 376 | agaaggttcagacttt | 3-9-4 | AGAaggttcagaCTTT | 376_1 | 8835 | -20 |

TABLE 5-continued list of oligonucleotide motif sequences (indicated by SEQ ID NO) targeting the human PD-L1 transcript (SEQ ID NO: 1), designs of these, as well as specific antisense oligonucleotide compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 377 | gcagaaggttcagact | 2-11-3 | GCagaaggttcagACT | 377_1 | 8837 | −21 |
| 377 | gcagaaggttcagact | 3-11-2 | GCAgaaggttcagaCT | 377_2 | 8837 | −22 |
| 378 | tgcagaaggttcagac | 4-10-2 | TGCAgaaggttcagAC | 378_1 | 8838 | −22 |
| 379 | agtgcagaaggttcag | 2-11-3 | AGtgcagaaggttCAG | 379_1 | 8840 | −20 |
| 379 | agtgcagaaggttcag | 4-10-2 | AGTGcagaaggttcAG | 379_2 | 8840 | −21 |
| 380 | aagtgcagaaggttca | 4-10-2 | AAGTgcagaaggttCA | 380_1 | 8841 | −20 |
| 381 | taagtgcagaaggttc | 2-10-4 | TAagtgcagaagGTTC | 381_1 | 8842 | −19 |
| 382 | tctaagtgcagaaggt | 2-10-4 | TCtaagtgcagaAGGT | 382_1 | 8844 | −21 |
| 383 | ctcaggagttctacttc | 3-12-2 | CTCaggagttctactTC | 383_1 | 8948 | −20 |
| 384 | ctcaggagttctactt | 3-10-3 | CTCaggagttctaCTT | 384_1 | 8949 | −21 |
| 385 | atggaggtgactcaggag | 1-15-2 | AtggaggtgactcaggAG | 385_1 | 8957 | −20 |
| 386 | atggaggtgactcagga | 2-13-2 | ATggaggtgactcagGA | 386_1 | 8958 | −21 |
| 387 | atggaggtgactcagg | 2-11-3 | ATggaggtgactcAGG | 387_1 | 8959 | −21 |
| 388 | tatggaggtgactcagg | 2-12-3 | TAtggaggtgactcAGG | 388_1 | 8959 | −21 |
| 389 | atatggaggtgactcagg | 2-14-2 | ATatggaggtgactcaGG | 389_1 | 8959 | −21 |
| 390 | tatggaggtgactcag | 4-10-2 | TATGgaggtgactcAG | 390_1 | 8960 | −21 |
| 391 | atatggaggtgactcag | 2-11-4 | ATatggaggtgacTCAG | 391_1 | 8960 | −22 |
| 392 | catatggaggtgactcag | 2-14-2 | CAtatggaggtgactcAG | 392_1 | 8960 | −20 |
| 393 | atatggaggtgactca | 3-10-3 | ATAtggaggtgacTCA | 393_1 | 8961 | −20 |
| 394 | catatggaggtgactca | 2-12-3 | CAtatggaggtgacTCA | 394_1 | 8961 | −21 |
| 395 | catatggaggtgactc | 2-10-4 | CAtatggaggtgACTC | 395_1 | 8962 | −20 |
| 396 | gcatatggaggtgactc | 2-13-2 | GCatatggaggtgacTC | 396_1 | 8962 | −21 |
| 397 | tgcatatggaggtgactc | 2-14-2 | TGcatatggaggtgacTC | 397_1 | 8962 | −21 |
| 398 | ttgcatatggaggtgactc | 1-16-2 | TtgcatatggaggtgacTC | 398_1 | 8962 | −20 |
| 399 | tttgcatatggaggtgactc | 1-17-2 | TttgcatatggaggtgacTC | 399_1 | 8962 | −21 |
| 400 | gcatatggaggtgact | 2-12-2 | GCatatggaggtgaCT | 400_1 | 8963 | −20 |
| 401 | tgcatatggaggtgact | 2-13-2 | TGcatatggaggtgaCT | 401_1 | 8963 | −20 |
| 402 | ttgcatatggaggtgact | 3-13-2 | TTGcatatggaggtgaCT | 402_1 | 8963 | −22 |
| 403 | tttgcatatggaggtgact | 1-16-2 | TttgcatatggaggtgaCT | 403_1 | 8963 | −20 |
| 404 | tgcatatggaggtgac | 3-11-2 | TGCatatggaggtgAC | 404_1 | 8964 | −20 |
| 405 | ttgcatatggaggtgac | 3-11-3 | TTGcatatggaggtGAC | 405_1 | 8964 | −21 |
| 406 | tttgcatatggaggtgac | 4-12-2 | TTTGcatatggaggtgAC | 406_1 | 8964 | −21 |
| 407 | tttgcatatggaggtga | 4-11-2 | TTTGcatatggaggtGA | 407_1 | 8965 | −21 |
| 408 | tttgcatatggaggtg | 2-10-4 | TTtgcatatggaGGTG | 408_1 | 8966 | −21 |
| 409 | aagtgaagttcaacagc | 2-11-4 | AAgtgaagttcaaCAGC | 409_1 | 8997 | −20 |
| 410 | tgggaagtgaagttca | 2-10-4 | TGggaagtgaagTTCA | 410_1 | 9002 | −20 |

TABLE 5-continued list of oligonucleotide motif sequences (indicated by SEQ ID NO) targeting the human
PD-L1 transcript (SEQ ID NO: 1), designs of these, as well as specific antisense oligonucleotide
compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 411 | atgggaagtgaagttc | 2-11-3 | ATgggaagtgaagTTC | 411_1 | 9003 | -17 |
| 412 | gatgggaagtgaagtt | 4-9-3 | GATGggaagtgaaGTT | 412_1 | 9004 | -21 |
| 413 | ctgtgatgggaagtgaa | 3-11-3 | CTGtgatgggaagtGAA | 413_1 | 9007 | -20 |
| 414 | attgagtgaatccaaa | 3-10-3 | ATTgagtgaatccAAA | 414_1 | 9119 | -14 |
| 415 | aattgagtgaatccaa | 2-10-4 | AAttgagtgaatCCAA | 415_1 | 9120 | -16 |
| 416 | gataattgagtgaatcc | 4-10-3 | GATAattgagtgaaTCC | 416_1 | 9122 | -20 |
| 417 | gtgataattgagtgaa | 3-10-3 | GTGataattgagtGAA | 417_1 | 9125 | -16 |
| 418 | aagaaaggtgcaataa | 3-10-3 | AAGaaaggtgcaaTAA | 418_1 | 9155 | -14 |
| 419 | caagaaaggtgcaata | 2-10-4 | CAagaaaggtgcAATA | 419_1 | 9156 | -15 |
| 420 | acaagaaaggtgcaat | 4-10-2 | ACAAgaaaggtgcaAT | 420_1 | 9157 | -16 |
| 421 | atttaaactcacaaac | 2-12-2 | ATttaaactcacaaAC | 421_1 | 9171 | -10 |
| 422 | ctgttaggttcagcga | 2-10-4 | CTgttaggttcaGCGA | 422_1 | 9235 | -24 |
| 423 | tctgaatgaacatttcg | 4-9-4 | TCTGaatgaacatTTCG | 423_1 | 9260 | -20 |
| 424 | ctcattgaaggttctg | 2-10-4 | CTcattgaaggtTCTG | 424_1 | 9281 | -20 |
| 425 | ctaatctcattgaagg | 3-11-2 | CTAatctcattgaaGG | 425_1 | 9286 | -17 |
| 426 | cctaatctcattgaag | 2-12-2 | CCtaatctcattgaAG | 426_1 | 9287 | -16 |
| 427 | actttgatctttcagc | 3-10-3 | ACTttgatctttcAGC | 427_1 | 9305 | -20 |
| 428 | actatgcaacactttg | 2-12-2 | ACtatgcaacactTTG | 428_1 | 9315 | -15 |
| 429 | caaatagctttatcgg | 3-10-3 | CAAatagctttatCGG | 429_1 | 9335 | -17 |
| 430 | ccaaatagctttatcg | 2-10-4 | CCaaatagctttATCG | 430_1 | 9336 | -19 |
| 431 | tccaaatagctttatc | 4-10-2 | TCCAaatagctttaTC | 431_1 | 9337 | -18 |
| 432 | gatccaaatagcttta | 4-10-2 | GATCcaaatagcttTA | 432_1 | 9339 | -18 |
| 433 | atgatccaaatagctt | 2-10-4 | ATgatccaaataGCTT | 433_1 | 9341 | -19 |
| 434 | tatgatccaaatagct | 4-10-2 | TATGatccaaatagCT | 434_1 | 9342 | -18 |
| 435 | taaacagggctgggaat | 4-9-4 | TAAAcagggctggGAAT | 435_1 | 9408 | -22 |
| 436 | acttaaacagggctgg | 2-10-4 | ACttaaacagggCTGG | 436_1 | 9412 | -21 |
| 437 | acacttaaacagggct | 2-10-4 | ACacttaaacagGGCT | 437_1 | 9414 | -22 |
| 438 | gaacacttaaacaggg | 4-8-4 | GAACacttaaacAGGG | 438_1 | 9416 | -20 |
| 439 | agagaacacttaaacag | 4-9-4 | AGAGaacacttaaACAG | 439_1 | 9418 | -20 |
| 440 | ctacagagaacactta | 4-8-4 | CTACagagaacaCTTA | 440_1 | 9423 | -20 |
| 441 | atgctacagagaacact | 3-10-4 | ATGctacagagaaCACT | 441_1 | 9425 | -22 |
| 442 | ataaatgctacagagaaca | 4-11-4 | ATAAatgctacagagAACA | 442_1 | 9427 | -20 |
| 443 | agataaatgctacagaga | 2-12-4 | AGataaatgctacaGAGA | 443_1 | 9430 | -20 |
| 444 | tagagataaatgctaca | 4-9-4 | TAGAgataaatgcTACA | 444_1 | 9434 | -21 |
| 445 | tagatagagataaatgct | 4-11-3 | TAGAtagagataaatGCT | 445_1 | 9437 | -20 |
| 446 | caatatactagatagaga | 4-10-4 | CAATatactagataGAGA | 446_1 | 9445 | -21 |
| 447 | tacacaatatactagatag | 4-11-4 | TACAcaatatactagATAG | 447_1 | 9448 | -21 |

TABLE 5-continued list of oligonucleotide motif sequences (indicated by SEQ ID NO) targeting the human
PD-L1 transcript (SEQ ID NO: 1), designs of these, as well as specific antisense oligonucleotide
compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 448 | ctacacaatatactag | 3-10-3 | CTAcacaatatacTAG | 448_1 | 9452 | -16 |
| 449 | gctacacaatatacta | 4-8-4 | GCTAcacaatatACTA | 449_1 | 9453 | -21 |
| 450 | atatgctacacaatatac | 4-10-4 | ATATgctacacaatATAC | 450_1 | 9455 | -20 |
| 451 | tgatatgctacacaat | 4-8-4 | TGATatgctacaCAAT | 451_1 | 9459 | -20 |
| 452 | atgatatgatatgctac | 4-9-4 | ATGAtatgatatgCTAC | 452_1 | 9464 | -21 |
| 453 | gaggagagagacaataaa | 4-10-4 | GAGGagagagacaaTAAA | 453_1 | 9495 | -20 |
| 454 | ctaggaggagagagaca | 3-11-3 | CTAggaggagagagACA | 454_1 | 9500 | -22 |
| 455 | tattctaggaggagaga | 4-10-3 | TATTctaggaggagAGA | 455_1 | 9504 | -21 |
| 456 | ttatattctaggaggag | 4-10-3 | TTATattctaggagGAG | 456_1 | 9507 | -21 |
| 457 | gtttatattctaggag | 3-9-4 | GTTtatattctaGGAG | 457_1 | 9510 | -20 |
| 458 | tggagtttatattctagg | 2-12-4 | TGgagtttatattcTAGG | 458_1 | 9512 | -22 |
| 459 | cgtaccaccactctgc | 2-11-3 | CGtaccaccactcTGC | 459_1 | 9590 | -25 |
| 460 | tgaggaaatcattcattc | 4-10-4 | TGAGgaaatcattcATTC | 460_1 | 9641 | -22 |
| 461 | tttgaggaaatcattcat | 4-10-4 | TTTGaggaaatcatTCAT | 461_1 | 9643 | -20 |
| 462 | aggctaatcctatttg | 4-10-2 | AGGCtaatcctattTG | 462_1 | 9657 | -22 |
| 463 | tttaggctaatcctat | 4-8-4 | TTTAggctaatcCTAT | 463_1 | 9660 | -22 |
| 464 | tgctccagtgtaccct | 3-11-2 | TGCtccagtgtaccCT | 464_1 | 9755 | -27 |
| 465 | tagtagtactcgatag | 2-10-4 | TAgtagtactcgATAG | 465_1 | 9813 | -18 |
| 466 | ctaattgtagtagtactc | 3-12-3 | CTAattgtagtagtaCTC | 466_1 | 9818 | -20 |
| 467 | tgctaattgtagtagt | 2-10-4 | TGctaattgtagTAGT | 467_1 | 9822 | -19 |
| 468 | agtgctaattgtagta | 4-10-2 | AGTGctaattgtagTA | 468_1 | 9824 | -19 |
| 469 | gcaagtgctaattgta | 4-10-2 | GCAAgtgctaattgTA | 469_1 | 9827 | -20 |
| 470 | gaggaaatgaactaatttta | 4-13-2 | GAGGaaatgaactaattTA | 470_1 | 9881 | -18 |
| 471 | caggaggaaatgaacta | 4-11-2 | CAGGaggaaatgaacTA | 471_1 | 9886 | -19 |
| 472 | ccctagagtcatttcc | 2-11-3 | CCctagagtcattTCC | 472_1 | 9902 | -24 |
| 473 | atcttacatgatgaagc | 3-11-3 | ATCttacatgatgaAGC | 473_1 | 9925 | -20 |
| 475 | agacacactcagatttcag | 2-15-2 | AGacacactcagatttcAG | 475_1 | 9967 | -20 |
| 474 | gacacactcagatttcag | 3-13-2 | GACacacactcagatttcAG | 474_1 | 9967 | -20 |
| 476 | aagacacactcagatttcag | 3-15-2 | AAGacacactcagatttcAG | 476_1 | 9967 | -21 |
| 477 | agacacactcagatttca | 2-13-3 | AGacacactcagattTCA | 477_1 | 9968 | -20 |
| 478 | aagacacactcagatttca | 3-13-3 | AAGacacactcagattTCA | 478_1 | 9968 | -21 |
| 479 | aaagacacactcagatttca | 2-14-4 | AAagacacactcagatTTCA | 479_1 | 9968 | -20 |
| 480 | gaaagacacactcagatttc | 3-14-3 | GAAagacacactcagatTTC | 480_1 | 9969 | -20 |
| 481 | aagacacactcagatttc | 4-11-3 | AAGacacactcagatTTC | 481_1 | 9969 | -21 |
| 482 | aaagacacactcagatttc | 4-11-4 | AAAgacacactcagaTTTC | 482_1 | 9969 | -20 |
| 483 | tgaaagacacactcagattt | 4-14-2 | TGAAagacacactcagatTT | 483_1 | 9970 | -20 |

TABLE 5-continued list of oligonucleotide motif sequences (indicated by SEQ ID NO) targeting the human
PD-L1 transcript (SEQ ID NO: 1), designs of these, as well as specific antisense oligonucleotide
compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 484 | tgaaagacacactcagatt | 2-13-4 | TGaaagacacactcaGATT | 484_1 | 9971 | -21 |
| 485 | tgaaagacacactcagat | 3-12-3 | TGAaaagacacactcaGAT | 485_1 | 9972 | -20 |
| 486 | attgaaagacacactca | 4-10-3 | ATTGaaagacacacTCA | 486_1 | 9975 | -19 |
| 487 | tcattgaaagacacact | 2-11-4 | TCattgaaagacaCACT | 487_1 | 9977 | -18 |
| 488 | ttccatcattgaaaga | 3-9-4 | TTCcatcattgaAAGA | 488_1 | 9983 | -18 |
| 489 | ataataccacttatcat | 4-9-4 | ATAAtaccacttaTCAT | 489_1 | 10010 | -20 |
| 490 | ttacttaatttctttgga | 2-12-4 | TTacttaatttcttTGGA | 490_1 | 10055 | -20 |
| 491 | ttagaactagctttatca | 3-12-3 | TTAgaactagctttaTCA | 491_1 | 10101 | -20 |
| 492 | gaggtacaaatatagg | 3-10-3 | GAGgtacaaatatAGG | 492_1 | 10171 | -18 |
| 493 | cttatgatacaactta | 3-10-3 | CTTatgatacaacTTA | 493_1 | 10384 | -15 |
| 494 | tcttatgatacaactt | 2-11-3 | TCttatgatacaaCTT | 494_1 | 10385 | -15 |
| 495 | ttcttatgatacaact | 3-11-2 | TTCttatgatacaaCT | 495_1 | 10386 | -15 |
| 496 | cagtttcttatgatac | 2-11-3 | CAgtttcttatgaTAC | 496_1 | 10390 | -16 |
| 497 | gcagtttcttatgata | 3-11-2 | GCAgtttcttatgaTA | 497_1 | 10391 | -19 |
| 498 | tacaaatgtctattaggtt | 4-12-3 | TACAaatgtctattagGTT | 498_1 | 10457 | -21 |
| 499 | tgtacaaatgtctattag | 4-11-3 | TGTAcaaatgtctatTAG | 499_1 | 10460 | -20 |
| 500 | agcatcacaattagta | 3-11-2 | AGCatcacaattagTA | 500_1 | 10535 | -18 |
| 501 | ctaatgatagtgaagc | 3-11-2 | CTAatgatagtgaaGC | 501_1 | 10548 | -17 |
| 502 | agctaatgatagtgaa | 3-11-2 | AGCtaatgatagtgAA | 502_1 | 10550 | -16 |
| 503 | atgccttgacatatta | 4-10-2 | ATGCcttgacatatTA | 503_1 | 10565 | -20 |
| 504 | ctcaagattattgacac | 4-9-4 | CTCAagattattgACAC | 504_1 | 10623 | -20 |
| 505 | acctcaagattattga | 2-10-4 | ACctcaagattaTTGA | 505_2 | 10626 | -18 |
| 505 | acctcaagattattga | 3-9-4 | ACCtcaagattaTTGA | 505_1 | 10626 | -20 |
| 506 | aacctcaagattattg | 4-10-2 | AACCtcaagattatTG | 506_1 | 10627 | -17 |
| 507 | cacaaacctcaagattatt | 4-13-2 | CACAaacctcaagattaTT | 507_1 | 10628 | -20 |
| 508 | gtacttaattagacct | 3-9-4 | GTActtaattagACCT | 508_1 | 10667 | -21 |
| 509 | agtacttaattagacc | 4-9-3 | AGTActtaattagACC | 509_1 | 10668 | -20 |
| 510 | gtatgaggtggtaaac | 4-10-2 | GTATgaggtggtaaAC | 510_1 | 10688 | -18 |
| 511 | aggaaacagcagaagtg | 2-11-4 | AGgaaacagcagaAGTG | 511_1 | 10723 | -21 |
| 512 | gcacaacccagaggaa | 2-12-2 | GCacaacccagaggAA | 512_1 | 10735 | -20 |
| 513 | caagcacaacccagag | 3-11-2 | CAAgcacaacccagAG | 513_1 | 10738 | -20 |
| 514 | ttcaagcacaacccag | 3-10-3 | TTCaagcacaaccCAG | 514_1 | 10740 | -21 |
| 515 | aattcaagcacaaccc | 2-10-4 | AAttcaagcacaACCC | 515_1 | 10742 | -20 |
| 516 | taataattcaagcacaacc | 4-13-2 | TAATaattcaagcacaaCC | 516_1 | 10743 | -20 |
| 517 | actaataattcaagcac | 4-9-4 | ACTAataattcaaGCAC | 517_1 | 10747 | -20 |
| 518 | ataatactaataattcaagc | 4-12-4 | ATAAtactaataattcAAGC | 518_1 | 10749 | -19 |
| 519 | tagatttgtgaggtaa | 2-10-4 | TAgatttgtgagGTAA | 519_1 | 11055 | -18 |

TABLE 5-continued list of oligonucleotide motif sequences (indicated by SEQ ID NO) targeting the human PD-L1 transcript (SEQ ID NO: 1), designs of these, as well as specific antisense oligonucleotide compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 520 | agccttaattctccat | 4-10-2 | AGCCttaattctccAT | 520_1 | 11091 | −24 |
| 521 | aatgatctagagcctta | 4-9-4 | AATgatctagagcCTTA | 521_1 | 11100 | −22 |
| 522 | ctaatgatctagagcc | 3-10-3 | CTAatgatctagaGCC | 522_1 | 11103 | −22 |
| 523 | actaatgatctagagc | 3-9-4 | ACTaatgatctaGAGC | 523_1 | 11104 | −21 |
| 524 | cattaacatgttcttatt | 3-11-4 | CATtaacatgttctTATT | 524_1 | 11165 | −19 |
| 525 | acaagtacattaacatgttc | 4-12-4 | ACAAgtacattaacatGTTC | 525_1 | 11170 | −22 |
| 526 | ttacaagtacattaacatg | 4-11-4 | TTACaagtacattaaCATG | 526_1 | 11173 | −20 |
| 527 | gctttattcatgtttat | 4-9-4 | GCTTtattcatgtTTAT | 527_1 | 11195 | −22 |
| 528 | gctttattcatgttta | 3-11-2 | GCTttattcatgttTA | 528_1 | 11196 | −18 |
| 529 | agagctttattcatgttt | 3-13-2 | AGAgctttattcatgtTT | 529_1 | 11197 | −20 |
| 530 | ataagagctttattcatg | 4-10-4 | ATAAgagctttattCATG | 530_1 | 11200 | −21 |
| 531 | cataagagctttattca | 4-9-4 | CATAagagctttaTTCA | 531_1 | 11202 | −21 |
| 532 | agcataagagctttat | 4-8-4 | AGCAtaagagctTTAT | 532_1 | 11205 | −22 |
| 533 | tagattgtttagtgca | 3-10-3 | TAGattgtttagtGCA | 533_1 | 11228 | −20 |
| 534 | gtagattgtttagtgc | 2-10-4 | GTagattgtttaGTGC | 534_1 | 11229 | −21 |
| 535 | gacaattctagtagatt | 4-9-4 | GACAattctagtaGATT | 535_1 | 11238 | −21 |
| 536 | ctgacaattctagtag | 3-9-4 | CTGacaattctaGTAG | 536_1 | 11241 | −20 |
| 537 | gctgacaattctagta | 4-10-2 | GCTGacaattctagTA | 537_1 | 11242 | −21 |
| 538 | aggattaagatacgta | 2-12-2 | AGgattaagatacgTA | 538_1 | 11262 | −15 |
| 539 | caggattaagatacgt | 2-11-3 | CAggattaagataCGT | 539_1 | 11263 | −17 |
| 540 | tcaggattaagatacg | 3-11-2 | TCAggattaagataCG | 540_1 | 11264 | −16 |
| 541 | ttcaggattaagatac | 2-10-4 | TTcaggattaagATAC | 541_1 | 11265 | −15 |
| 542 | aggaagaaagtttgattc | 4-10-4 | AGGAagaaagtttgATTC | 542_1 | 11308 | −21 |
| 543 | tcaaggaagaaagtttga | 4-10-4 | TCAAggaagaaagtTTGA | 543_1 | 11311 | −20 |
| 544 | ctcaaggaagaaagtttg | 4-10-4 | CTCAaggaagaaagTTTG | 544_1 | 11312 | −20 |
| 545 | tgctcaaggaagaaagt | 3-10-4 | TGCtcaaggaagaAAGT | 545_1 | 11315 | −21 |
| 546 | aattatgctcaaggaaga | 4-11-3 | AATTatgctcaaggaAGA | 546_1 | 11319 | −20 |
| 547 | taggataccacattatga | 4-12-2 | TAGGataccacattatGA | 547_1 | 11389 | −22 |
| 548 | cataatttattccattcctc | 2-15-3 | CAtaatttattccattcCTC | 548_1 | 11449 | −22 |
| 549 | tgcataatttattccat | 4-10-3 | TGCAtaatttattcCAT | 549_1 | 11454 | −22 |
| 550 | actgcataatttattcc | 4-10-3 | ACTGcataatttatTCC | 550_1 | 11456 | −21 |
| 551 | ctaaactgcataatttatt | 4-11-4 | CTAAactgcataattTATT | 551_1 | 11458 | −20 |
| 552 | ataactaaactgcata | 2-10-4 | ATaactaaactgCATA | 552_1 | 11465 | −16 |
| 553 | ttattaataaactgc | 3-12-4 | TTAttaataaactaaaCTGC | 553_1 | 11468 | −19 |
| 554 | tagtacattattaataact | 4-13-2 | TAGtacattattaataaCT | 554_1 | 11475 | −18 |
| 555 | cataactaaggacgtt | 4-10-2 | CATAactaaggacgTT | 555_1 | 11493 | −17 |

TABLE 5-continued list of oligonucleotide motif sequences (indicated by SEQ ID NO) targeting the human
PD-L1 transcript (SEQ ID NO: 1), designs of these, as well as specific antisense oligonucleotide
compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 556 | tcataactaaggacgt | 2-11-3 | TCataactaaggaCGT | 556_1 | 11494 | -16 |
| 557 | cgtcataactaaggac | 4-10-2 | CGTCataactaaggAC | 557_1 | 11496 | -17 |
| 558 | tcgtcataactaagga | 2-12-2 | TCgtcataactaagGA | 558_1 | 11497 | -16 |
| 559 | atcgtcataactaagg | 2-10-4 | ATcgtcataactAAGG | 559_1 | 11498 | -17 |
| 560 | gttagtatcttacatt | 2-11-3 | GTtagtatcttacATT | 560_1 | 11525 | -15 |
| 561 | ctctattgttagtatc | 3-10-3 | CTCtattgttagtATC | 561_1 | 11532 | -17 |
| 562 | agtatagagttactgt | 3-10-3 | AGTatagagttacTGT | 562_1 | 11567 | -19 |
| 563 | ttcctggtgatacttt | 4-10-2 | TTCCtggtgatactTT | 563_1 | 11644 | -21 |
| 564 | gttcctggtgatactt | 4-10-2 | GTTCctggtgatacTT | 564_1 | 11645 | -21 |
| 565 | tgttcctggtgatact | 2-12-2 | TGttcctggtgataCT | 565_1 | 11646 | -20 |
| 566 | ataaacatgaatctctcc | 2-12-4 | ATaaacatgaatctCTCC | 566_1 | 11801 | -20 |
| 567 | ctttataaacatgaatctc | 3-12-4 | CTTtataaacatgaaTCTC | 567_1 | 11804 | -19 |
| 568 | ctgtctttataaacatg | 3-10-4 | CTGtctttataaaCATG | 568_1 | 11810 | -19 |
| 569 | ttgttataaatctgtctt | 2-12-4 | TTgttataaatctgTCTT | 569_1 | 11820 | -18 |
| 570 | ttaaatttattcttggata | 3-12-4 | TTAaatttattcttgGATA | 570_1 | 11849 | -19 |
| 571 | cttaaatttattcttgga | 2-12-4 | CTtaaatttattctTGGA | 571_1 | 11851 | -19 |
| 572 | cttcttaaatttattcttg | 4-13-2 | CTTCttaaatttattctTG | 572_1 | 11853 | -18 |
| 573 | tatgtttctcagtaaag | 4-9-4 | TATGtttctcagtAAAG | 573_1 | 11877 | -19 |
| 574 | gaattatctttaaacca | 3-10-4 | GAAttatctttaaACCA | 574_1 | 11947 | -18 |
| 575 | cccttaaatttctaca | 3-11-2 | CCCttaaatttctaCA | 575_1 | 11980 | -20 |
| 576 | acactgctcttgtacc | 4-10-2 | ACACtgctcttgtaCC | 576_1 | 11995 | -23 |
| 577 | tgacaacactgctctt | 3-10-3 | TGAcaacactgctCTT | 577_1 | 12000 | -21 |
| 578 | tacatttattgggctc | 4-10-2 | TACAtttattgggcTC | 578_1 | 12081 | -19 |
| 579 | gtacatttattgggct | 2-10-4 | GTacatttattgGGCT | 579_1 | 12082 | -23 |
| 580 | ttggtacatttattgg | 3-10-3 | TTGgtacatttatTGG | 580_1 | 12085 | -18 |
| 581 | catgttggtacatttat | 4-10-3 | CATGttggtacattTAT | 581_1 | 12088 | -21 |
| 582 | aatcatgttggtacat | 4-10-2 | AATCatgttggtacAT | 582_1 | 12092 | -16 |
| 583 | aaatcatgttggtaca | 2-12-2 | AAatcatgttggtaCA | 583_1 | 12093 | -14 |
| 584 | gacaagtttggattaa | 3-11-2 | GACaagtttggattAA | 584_1 | 12132 | -14 |
| 585 | aatgttcagatgcctc | 2-10-4 | AAtgttcagatgCCTC | 585_1 | 12197 | -21 |
| 586 | gcttaatgttcagatg | 2-12-2 | GCttaatgttcagaTG | 586_1 | 12201 | -17 |
| 587 | cgtacatagcttgatg | 4-10-2 | CGTAcatagcttgaTG | 587_1 | 12267 | -20 |
| 588 | gtgaggaattaggata | 3-11-2 | GTGaggaattaggaTA | 588_1 | 12753 | -17 |
| 589 | gtaacaatatggtttg | 3-11-2 | GTAacaatatggttTG | 589_1 | 12780 | -15 |
| 590 | gaaatattgtagacta | 2-11-3 | GAaatattgtagaCTA | 590_1 | 13151 | -14 |
| 591 | ttgaaatattgtagac | 3-11-2 | TTGaaatattgtagAC | 591_1 | 13153 | -12 |
| 592 | aagtctagtaatttgc | 2-10-4 | AAgtctagtaatTTGC | 592_1 | 13217 | -17 |

TABLE 5-continued list of oligonucleotide motif sequences (indicated by SEQ ID NO) targeting the human PD-L1 transcript (SEQ ID NO: 1), designs of these, as well as specific antisense oligonucleotide compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 593 | gctcagtagattataa | 4-10-2 | GCTcagtagattatAA | 593_1 | 13259 | -17 |
| 594 | catacactgttgctaa | 3-10-3 | CATacactgttgcTAA | 594_1 | 13296 | -19 |
| 595 | atggtctcaaatcatt | 3-10-3 | ATGgtctcaaatcATT | 595_1 | 13314 | -17 |
| 596 | caatggtctcaaatca | 4-10-2 | CAATggtctcaaatCA | 596_1 | 13316 | -18 |
| 597 | ttcctattgattgact | 4-10-2 | TTCCtattgattgaCT | 597_1 | 13568 | -20 |
| 598 | tttctgttcacaacac | 4-10-2 | TTTCtgttcacaacAC | 598_1 | 13600 | -17 |
| 599 | aggaacccactaatct | 2-11-3 | AGgaacccactaaTCT | 599_1 | 13702 | -20 |
| 600 | taaatggcaggaaccc | 3-11-2 | TAAatggcaggaacCC | 600_1 | 13710 | -19 |
| 601 | gtaaatggcaggaacc | 4-10-2 | GTAAatggcaggaaCC | 601_1 | 13711 | -20 |
| 602 | ttgtaaatggcaggaa | 2-11-3 | TTgtaaatggcagGAA | 602_1 | 13713 | -16 |
| 603 | ttatgagttaggcatg | 2-10-4 | TTatgagttaggCATG | 603_1 | 13835 | -19 |
| 604 | ccaggtgaaactttaa | 3-11-2 | CCAggtgaaactttAA | 604_1 | 13935 | -17 |
| 605 | cccttagtcagctcct | 3-10-3 | CCCttagtcagctCCT | 605_1 | 13997 | -30 |
| 606 | acccttagtcagctcc | 2-10-4 | ACccttagtcagCTCC | 606_1 | 13998 | -27 |
| 607 | cacccttagtcagctc | 2-11-3 | CAcccttagtcagCTC | 607_1 | 13999 | -24 |
| 608 | tctcttactaggctcc | 3-10-3 | TCTcttactaggcTCC | 608_1 | 14091 | -24 |
| 609 | cctatctgtcatcatg | 2-11-3 | CCtatctgtcatcATG | 609_1 | 14178 | -20 |
| 610 | tcctatctgtcatcat | 3-11-2 | TCCtatctgtcatcAT | 610_1 | 14179 | -20 |
| 611 | gagaagtgtgagaagc | 3-11-2 | GAGaagtgtgagaaGC | 611_1 | 14808 | -19 |
| 612 | catccttgaagtttag | 4-10-2 | CATCcttgaagttTAG | 612_1 | 14908 | -19 |
| 613 | taataagatggctccc | 3-10-3 | TAAtaagatggctCCC | 613_1 | 15046 | -21 |
| 614 | caaggcataataagat | 3-11-2 | CAAggcataataagAT | 614_1 | 15053 | -14 |
| 615 | ccaaggcataataaga | 2-10-4 | CCaaggcataatAAGA | 615_1 | 15054 | -18 |
| 616 | tgatccaattctcacc | 2-12-2 | TGatccaattctcaCC | 616_1 | 15151 | -19 |
| 617 | atgatccaattctcac | 3-10-3 | ATGatccaattctCAC | 617_1 | 15152 | -19 |
| 618 | cgcttcatcttcaccc | 3-11-2 | CGCttcatcttcacCC | 618_1 | 15260 | -26 |
| 619 | tatgacactgcatctt | 2-10-4 | TAtgacactgcaTCTT | 619_1 | 15317 | -19 |
| 620 | gtatgacactgcatct | 3-10-3 | GTAtgacactgcaTCT | 620_1 | 15318 | -21 |
| 621 | tgtatgacactgcatc | 2-10-4 | TGtatgacactgCATC | 621_1 | 15319 | -20 |
| 622 | ttctcttctgtaagtc | 4-10-2 | TTCTcttctgtaagTC | 622_1 | 15363 | -19 |
| 623 | ttctacagaggaacta | 2-10-4 | TTctacagaggaACTA | 623_1 | 15467 | -17 |
| 624 | actacagttctacaga | 3-10-3 | ACTacagttctacAGA | 624_1 | 15474 | -19 |
| 625 | ttcccacaggtaaatg | 4-10-2 | TTCCcacaggtaaaTG | 625_1 | 15561 | -21 |
| 626 | attatttgaatatactcatt | 4-12-4 | ATTAtttgaatatactCATT | 626_1 | 15594 | -20 |
| 627 | tgggaggaaattatttg | 4-10-3 | TGGGaggaaattatTTG | 627_1 | 15606 | -20 |
| 628 | tgactcatcttaaatg | 4-10-2 | TGACtcatcttaaaTG | 628_1 | 15621 | -17 |

TABLE 5-continued list of oligonucleotide motif sequences (indicated by SEQ ID NO) targeting the human
PD-L1 transcript (SEQ ID NO: 1), designs of these, as well as specific antisense oligonucleotide
compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 629 | ctgactcatcttaaat | 3-11-2 | CTGactcatcttaaAT | 629_1 | 15622 | -16 |
| 630 | tttactctgactcatc | 3-10-3 | TTTactctgactcATC | 630_1 | 15628 | -17 |
| 631 | tattggaggaattatt | 3-11-2 | TATtggaggaattaTT | 631_1 | 15642 | -14 |
| 632 | gtattggaggaattat | 3-11-2 | GTAttggaggaattAT | 632_1 | 15643 | -16 |
| 633 | tggtatacttctctaagtat | 2-15-3 | TGgtatacttctctaagTAT | 633_1 | 15655 | -22 |
| 634 | gatctcttggtatact | 4-10-2 | GATCtcttggtataCT | 634_1 | 15666 | -20 |
| 635 | cagacaactctatacc | 2-12-2 | CAgacaactctataCC | 635_1 | 15689 | -18 |
| 636 | aacatcagacaactcta | 4-9-4 | AACAtcagacaacTCTA | 636_1 | 15693 | -21 |
| 637 | taacatcagacaactc | 4-10-2 | TAACatcagacaacTC | 637_1 | 15695 | -16 |
| 638 | tttaacatcagacaactc | 4-10-4 | TTTAacatcagacaACTC | 638_1 | 15695 | -20 |
| 639 | atttaacatcagacaa | 2-12-2 | ATttaacatcagacAA | 639_1 | 15698 | -11 |
| 640 | cctatttaacatcagac | 2-11-4 | CCtatttaacatcAGAC | 640_1 | 15700 | -20 |
| 641 | tccctatttaacatca | 3-10-3 | TCCctatttaacaTCA | 641_1 | 15703 | -21 |
| 642 | tcaacgactattggaat | 4-9-4 | TCAAcgactattgGAAT | 642_1 | 15737 | -20 |
| 643 | cttatattctggctat | 4-9-3 | CTTAtattctggcTAT | 643_1 | 15850 | -20 |
| 644 | atccttatattctggc | 4-10-2 | ATCCttatattctgGC | 644_1 | 15853 | -23 |
| 645 | gatccttatattctgg | 2-10-4 | GAtccttatattCTGG | 645_1 | 15854 | -21 |
| 646 | tgatccttatattctg | 3-10-3 | TGAtccttatattCTG | 646_1 | 15855 | -19 |
| 647 | attgaaacttgatcct | 4-8-4 | ATTGaaacttgaTCCT | 647_1 | 15864 | -21 |
| 648 | actgtcattgaaactt | 2-10-4 | ACtgtcattgaaACTT | 648_1 | 15870 | -16 |
| 649 | tcttactgtcattgaa | 3-11-2 | TCTtactgtcattgAA | 649_1 | 15874 | -16 |
| 650 | aggatcttactgtcatt | 2-11-4 | AGgatcttactgtCATT | 650_1 | 15877 | -21 |
| 651 | gcaaatcaactccatc | 3-10-3 | GCAaatcaactccATC | 651_1 | 15896 | -20 |
| 652 | gtgcaaatcaactcca | 3-10-3 | GTGcaaatcaactCCA | 652_1 | 15898 | -22 |
| 653 | caattatttctttgtgc | 4-10-3 | CAATtatttctttgTGC | 653_1 | 15910 | -21 |
| 654 | tggcaacaattatttctt | 3-11-4 | TGGcaacaattattTCTT | 654_1 | 15915 | -21 |
| 655 | gctggcaacaattatt | 3-9-4 | GCTggcaacaatTATT | 655_1 | 15919 | -21 |
| 656 | atccatttctactgcc | 4-10-2 | ATCCatttctactgCC | 656_1 | 15973 | -24 |
| 657 | taatatctattgatttcta | 4-11-4 | TAATatctattgattTCTA | 657_1 | 15988 | -20 |
| 658 | tcaatagtgtagggca | 2-12-2 | TCaatagtgtagggCA | 658_1 | 16093 | -18 |
| 659 | ttcaatagtgtagggc | 3-11-2 | TTCaatagtgtaggGC | 659_1 | 16094 | -19 |
| 660 | aggttaattaattcaatag | 4-11-4 | AGGTtaattaattcaATAG | 660_1 | 16102 | -21 |
| 661 | catttgtaatccctag | 3-10-3 | CATttgtaatcccTAG | 661_2 | 16163 | -20 |
| 661 | catttgtaatccctag | 3-9-4 | CATttgtaatccCTAG | 661_1 | 16163 | -22 |
| 662 | acatttgtaatcccta | 3-10-3 | ACAtttgtaatccCTA | 662_1 | 16164 | -20 |
| 663 | aacatttgtaatccct | 2-10-4 | AAcatttgtaatCCCT | 663_2 | 16165 | -21 |
| 663 | aacatttgtaatccct | 3-9-4 | AACatttgtaatCCCT | 663_1 | 16165 | -22 |

TABLE 5-continued list of oligonucleotide motif sequences (indicated by SEQ ID NO) targeting the human
PD-L1 transcript (SEQ ID NO: 1), designs of these, as well as specific antisense oligonucleotide
compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 664 | taaatttcaagttctg | 2-11-3 | TAaatttcaagttCTG | 664_1 | 16184 | -14 |
| 665 | gtttaaatttcaagttct | 3-11-4 | GTTtaaatttcaagTTCT | 665_1 | 16185 | -19 |
| 666 | ccaagtttaaatttcaag | 4-10-4 | CCAAgtttaaatttCAAG | 666_1 | 16189 | -21 |
| 667 | acccaagtttaaatttc | 4-9-4 | ACCCaagtttaaaTTTC | 667_1 | 16192 | -22 |
| 668 | catacagtgacccaagttt | 2-14-3 | CAtacagtgacccaagTTT | 668_1 | 16199 | -23 |
| 669 | acatcccatacagtga | 2-11-3 | ACatcccatacagTGA | 669_1 | 16208 | -21 |
| 670 | agcacagctctacatc | 2-10-4 | AGcacagctctaCATC | 670_1 | 16219 | -22 |
| 671 | atatagcacagctcta | 3-9-4 | ATAtagcacagcTCTA | 671_1 | 16223 | -21 |
| 672 | tccatatagcacagct | 3-11-2 | TCCatatagcacagCT | 672_1 | 16226 | -22 |
| 673 | atttccatatagcaca | 3-9-4 | ATTtccatatagCACA | 673_1 | 16229 | -20 |
| 674 | tttatttccatatagca | 4-9-4 | TTTAtttccatatAGCA | 674_1 | 16231 | -22 |
| 675 | tttatttccatatagc | 3-10-3 | TTTatttccatatAGC | 675_1 | 16232 | -18 |
| 676 | aaggagaggagattatg | 4-9-4 | AAGGagaggagatTATG | 676_1 | 16409 | -21 |
| 677 | agttcttgtgttagct | 3-11-2 | AGTtcttgtgttagCT | 677_1 | 16456 | -21 |
| 678 | gagttcttgtgttagc | 2-12-2 | GAgttcttgtgttaGC | 678_1 | 16457 | -20 |
| 679 | attaattatccatccac | 3-10-4 | ATTaattatccatCCAC | 679_1 | 16590 | -21 |
| 680 | atcaattaattatccatc | 3-11-4 | ATCaattaattatcCATC | 680_1 | 16593 | -19 |
| 681 | agaatcaattaattatcc | 3-12-3 | AGAatcaattaattaTCC | 681_1 | 16596 | -18 |
| 682 | tgagataccgtgcatg | 2-12-2 | TGagataccgtgcaTG | 682_1 | 16656 | -18 |
| 683 | aatgagataccgtgca | 2-10-4 | AAtgagataccgTGCA | 683_1 | 16658 | -21 |
| 684 | ctgtggttaggctaat | 3-11-2 | CTGtggttaggctaAT | 684_1 | 16834 | -19 |
| 685 | aagagtaagggtctgtggtt | 1-17-2 | AagagtaagggtctgtggTT | 685_1 | 16842 | -21 |
| 686 | gatgggttaagagtaa | 4-9-3 | GATGggttaagagTAA | 686_1 | 16854 | -19 |
| 687 | agcagatgggttaaga | 3-11-2 | AGCagatgggttaaGA | 687_1 | 16858 | -20 |
| 688 | tgtaaacatttgtagc | 2-10-4 | TGtaaacatttgTAGC | 688_1 | 16886 | -19 |
| 689 | cctgcttataaatgta | 3-11-2 | CCTgcttataaatgTA | 689_1 | 16898 | -19 |
| 690 | tgccctgcttataaat | 4-10-2 | TGCCctgcttataaAT | 690_1 | 16901 | -23 |
| 691 | tcttcttagttcaata | 2-12-2 | TCttcttagttcaaTA | 691_1 | 16935 | -15 |
| 692 | tggtttctaactacat | 2-10-4 | TGgtttctaactACAT | 692_1 | 16980 | -18 |
| 693 | agtttggtttctaacta | 2-12-3 | AGtttggtttctaaCTA | 693_1 | 16983 | -19 |
| 694 | gaatgaaacttgcctg | 3-10-3 | GAAtgaaacttgcCTG | 694_1 | 17047 | -18 |
| 695 | attatccttacatgat | 3-10-3 | ATTatccttacatGAT | 695_1 | 17173 | -17 |
| 696 | gtacccaattatcctt | 2-11-3 | GTacccaattatcCTT | 696_1 | 17180 | -21 |
| 697 | tgtacccaattatcct | 3-10-3 | TGTacccaattatCCT | 697_1 | 17181 | -24 |
| 698 | ttgtacccaattatcc | 2-11-3 | TTgtacccaattaTCC | 698_1 | 17182 | -20 |
| 699 | tttgtacccaattatc | 3-11-2 | TTTgtacccaattaTC | 699_1 | 17183 | -17 |

TABLE 5-continued list of oligonucleotide motif sequences (indicated by SEQ ID NO) targeting the human
PD-L1 transcript (SEQ ID NO: 1), designs of these, as well as specific antisense oligonucleotide
compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 700 | agcagcaggttatatt | 4-10-2 | AGCAgcaggttataTT | 700_1 | 17197 | -22 |
| 701 | tgggaagtggtctggg | 3-10-3 | TGGgaagtggtctGGG | 701_1 | 17292 | -25 |
| 702 | ctggagagtgataata | 3-11-2 | CTGgagagtgataaTA | 702_1 | 17322 | -17 |
| 703 | aatgctggattacgtc | 4-10-2 | AATGctggattacgTC | 703_1 | 17354 | -19 |
| 704 | caatgctggattacgt | 2-11-3 | CAatgctggattaCGT | 704_1 | 17355 | -19 |
| 705 | ttgttcagaagtatcc | 2-10-4 | TTgttcagaagtATCC | 705_1 | 17625 | -19 |
| 706 | gatgatttgcttggag | 2-10-4 | GAtgatttgcttGGAG | 706_1 | 17646 | -21 |
| 707 | gaaatcattcacaacc | 3-10-3 | GAAatcattcacaACC | 707_1 | 17860 | -17 |
| 708 | ttgtaacatctactac | 3-10-3 | TTGtaacatctacTAC | 708_1 | 17891 | -16 |
| 709 | cattaagcagcaagtt | 3-11-2 | CATtaagcagcaagTT | 709_1 | 17923 | -17 |
| 710 | ttactagatgtgagca | 3-11-2 | TTActagatgtgagCA | 710_1 | 17942 | -18 |
| 711 | tttactagatgtgagc | 2-11-3 | TTtactagatgtgAGC | 711_1 | 17943 | -18 |
| 712 | gaccaagcaccttaca | 3-11-2 | GACcaagcaccttaCA | 712_1 | 17971 | -22 |
| 713 | agaccaagcaccttac | 3-10-3 | AGAccaagcacctTAC | 713_1 | 17972 | -22 |
| 714 | atgggttaaataaagg | 2-10-4 | ATgggttaaataAAGG | 714_1 | 18052 | -15 |
| 715 | tcaaccagagtattaa | 2-12-2 | TCaaccagagtattAA | 715_1 | 18067 | -13 |
| 716 | gtcaaccagagtatta | 3-11-2 | GTCaaccagagtatTA | 716_1 | 18068 | -18 |
| 717 | attgtaaagctgatat | 2-11-3 | ATtgtaaagctgaTAT | 717_1 | 18135 | -14 |
| 718 | cacataattgtaaagc | 2-10-4 | CAcataattgtaAAGC | 718_1 | 18141 | -16 |
| 719 | gaggtctgctatttac | 2-11-3 | GAggtctgctattTAC | 719_1 | 18274 | -19 |
| 720 | tgtagattcaatgcct | 2-11-3 | TGtagattcaatgCCT | 720_1 | 18404 | -20 |
| 721 | cctcattatactatga | 2-11-3 | CCtcattatactaTGA | 721_1 | 18456 | -19 |
| 722 | ccttatgctatgacac | 2-12-2 | CCttatgctatgacAC | 722_1 | 18509 | -18 |
| 723 | tccttatgctatgaca | 4-10-2 | TCCTtatgctatgaCA | 723_1 | 18510 | -22 |
| 724 | aagatgtttaagtata | 3-10-3 | AAGatgtttaagtATA | 724_1 | 18598 | -13 |
| 725 | ctgattattaagatgt | 2-10-4 | CTgattattaagATGT | 725_1 | 18607 | -17 |
| 726 | tggaaaggtatgaatt | 2-12-2 | TGgaaaggtatgaaTT | 726_1 | 18808 | -13 |
| 727 | acttgaatggcttgga | 2-12-2 | ACttgaatggcttGA | 727_1 | 18880 | -18 |
| 728 | aacttgaatggcttgg | 3-10-3 | AACttgaatggctTGG | 728_1 | 18881 | -19 |
| 729 | caatgtgttactattt | 4-10-2 | CAATgtgttactatTT | 729_1 | 19004 | -16 |
| 730 | acaatgtgttactatt | 3-10-3 | ACAatgtgttactATT | 730_1 | 19005 | -15 |
| 731 | catctgctatataaga | 4-10-2 | CATCtgctatataaGA | 731_1 | 19063 | -18 |
| 732 | cctagagcaaatactt | 4-10-2 | CCTAgagcaaatacTT | 732_1 | 19223 | -20 |
| 733 | cagagttaataataag | 3-10-3 | CAGagttaataatAAG | 733_1 | 19327 | -13 |
| 734 | gttcaagcacaacgaa | 4-10-2 | GTTCaagcacaacgAA | 734_1 | 19493 | -18 |
| 735 | agggttcaagcacaac | 2-11-3 | AGggttcaagcacAAC | 735_1 | 19496 | -18 |
| 736 | tgttggagacactgtt | 2-12-2 | TGttggagacactgTT | 736_1 | 19677 | -17 |

TABLE 5-continued list of oligonucleotide motif sequences (indicated by SEQ ID NO) targeting the human PD-L1 transcript (SEQ ID NO: 1), designs of these, as well as specific antisense oligonucleotide compounds (indicated by CMP ID NO) designed based on the motif sequence.

| SEQ ID NO | Motif sequence | Design | Oligonucleotide Compound | CMP ID NO | Start ID NO: 1 | dG |
|---|---|---|---|---|---|---|
| 737 | aaggaggagttaggac | 3-11-2 | AAGgaggagttaggAC | 737_1 | 19821 | -18 |
| 738 | ctatgccatttacgat | 4-10-2 | CTATgccatttacgAT | 738_1 | 19884 | -21 |
| 739 | tcaaatgcagaattag | 2-12-2 | TCaaatgcagaattAG | 739_1 | 19913 | -12 |
| 740 | agtgacaatcaaatgc | 2-10-4 | AGtgacaatcaaATGC | 740_1 | 19921 | -18 |
| 741 | aagtgacaatcaaatg | 2-11-3 | AAgtgacaatcaaATG | 741_1 | 19922 | -12 |
| 742 | gtgtaccaagtaacaa | 3-11-2 | GTGtaccaagtaacAA | 742_1 | 19978 | -16 |
| 743 | tgggatgttaaactga | 3-10-3 | TGGgatgttaaacTGA | 743_1 | 20037 | -20 |

Motif sequences represent the contiguous sequence of nucleobases present in the oligonucleotide.

Designs refer to the gapmer design, F-G-F', where each number represents the number of consecutive modified nucleosides, e.g. 2' modified nucleosides (first number-5' flank), followed by the number of DNA nucleosides (second number=gep region), followed by the number of modified nucleosides, e.g. 2' modified nucleosides (third number-3' flank), optionally preceded by or followed by further repeated regions of DNA and LNA, which are not necessarily part of the contiguous sequence that is complementary to the target nucleic acid.

Oligonucleotide compounds represent specific designs of a motif sequence. Capital letters represent beta-D-oxy LNA nucleosides, lowercase letters represent DNA nucleosides, all LNA C are 5-methyl cytosine, all internucleoside linkages are phosphorothioate internucleoside linkages.

Designs refer to the gapmer design, F-G-F', where each number represents the number of consecutive modified nucleosides, e.g. 2' modified nucleosides (first number=5' flank), followed by the number of DNA nucleosides (second number=gap region), followed by the number of modified nucleosides, e.g. 2' modified nucleosides (third number=3' flank), optionally preceded by or followed by further repeated regions of DNA and LNA, which are not necessarily part of the contiguous sequence that is complementary to the target nucleic acid.

Oligonucleotide compounds represent specific designs of a motif sequence. Capital letters represent beta-D-oxy LNA nucleosides, lowercase letters represent DNA nucleosides, all LNA C are 5-methyl cytosine, all internucleoside linkages are phosphorothioate internucleoside linkages.

TABLE 6

Oligonucleotides targeting mouse PD-L1 transcript (SEQ ID NO: 4) designs of these, as well as specific oligonucleotide compounds (indicated by CMP ID NO) designed based on the motif sequence.

| SEQ ID NO | Motif sequence | Design | Oligonucleotide Compound | CMP ID NO | Start on SEQ ID NO: 4 | dG |
|---|---|---|---|---|---|---|
| 744 | agtttacattttctgc | 3-10-3 | AGTttacattttcTGC | 744_1 | 4189 | -20 |
| 745 | tatgtgaagaggagag | 3-10-3 | TATgtgaagaggaGAG | 745_1 | 7797 | -19 |
| 746 | cacctttaaaacccca | 3-10-3 | CACctttaaaaccCCA | 746_1 | 9221 | -23 |
| 747 | tcctttataatcacac | 3-10-3 | TCCtttataatcaCAC | 747_1 | 10386 | -19 |
| 748 | acggtattttcacagg | 3-10-3 | ACGgtattttcacAGG | 748_1 | 12389 | -21 |
| 749 | gacactacaatgagga | 3-10-3 | GACactacaatgaGGA | 749_1 | 15088 | -20 |
| 750 | tggttttaggactgt | 3-10-3 | TGGttttaggacTGT | 750_1 | 16410 | -21 |
| 751 | cgacaaattctatcct | 3-10-3 | CGAcaaattctatCCT | 751_1 | 18688 | -20 |
| 752 | tgatatacaatgctac | 3-10-3 | TGAtatacaatgcTAC | 752_1 | 18735 | -16 |
| 753 | tcgttgggtaaattta | 3-10-3 | TCGttgggtaaatTTA | 753_1 | 19495 | -17 |
| 754 | tgctttataaatggtg | 3-10-3 | TGCtttataaatgGTG | 754_1 | 19880 | -19 |

Motif sequences represent the contiguous sequence of nucleobases present in the oligonucleotide.

TABLE 7

Oligonucleotide motif sequences and antisense compounds with 5' ca biocleavable linker.

| SEQ ID NO | motif sequence | oligonucleotide compound with ca linker | CMP ID NO |
|---|---|---|---|
| 755 | caagtttacattttctgc | $c_o a_o$AGTttacattttcTGC | 755_1 |
| 756 | catatgtgaagaggagag | $c_o a_o$TATgtgaagaggaGAG | 756_1 |
| 757 | caccctttaaaacccca | $c_o a_o$CACctttaaaaccCCA | 757_1 |
| 758 | catcctttataatcacac | $c_o a_o$TCCtttataatcaCAC | 758_1 |
| 759 | caacggtattttcacagg | $c_o a_o$ACGgtattttcacAGG | 759_1 |
| 760 | cagacactacaatgagga | $c_o a_o$GACactacaatgaGGA | 760_1 |
| 761 | catggttttaggactgt | $c_o a_o$TGGtttttaggacTGT | 761_1 |
| 762 | cacgacaaattctatcct | $c_o a_o$CGAcaaattctatCCT | 762_1 |
| 763 | catgatatacaatgctac | $c_o a_o$TGAtatacaatgcTAC | 763_1 |
| 764 | catcgttgggtaaattta | $c_o a_o$TCGttgggtaaatTTA | 764_1 |
| 765 | catgctttataaatggtg | $c_o a_o$TGCtttataaatgGTG | 765_1 |
| 766 | caacaaataatggttactct | $c_o a_o$ACAAataatggttaCTCT | 766_1 |
| 767 | cacagattgatggtagtt | $c_o a_o$CAGAttgatggtagTT | 767_1 |
| 768 | caccctatttaacatcagac | $c_o a_o$CCtatttaacatcAGAC | 768_1 |
| 769 | cactaattgtagtagtactc | $c_o a_o$CTAattgtagtagtaCTC | 769_1 |
| 770 | caataaacatgaatctctcc | $c_o a_o$ATaaacatgaatctCTCC | 770_1 |

Capital letters represent beta-D-oxy LNA nucleosides, lowercase letters represent DNA nucleosides, all LNA C are 5-methyl cytosine, subscript o represent a phosphodiester internucleoside linkage and unless otherwise indicated other internucleoside linkages are phosphorothioate internucleoside linkages.

TABLE 8

GalNAc conjugated antisense oligonucleotide compounds.

| antisense oligonucleotide conjugate | CMP ID NO | SEQ ID NO |
|---|---|---|
| GN2-C6$_o c_o a_o$AGTttacattttcTGC | 755_2 | 744 |
| GN2-C6$_o c_o a_o$TATgtgaagaggaGAG | 756_2 | 745 |
| GN2-C6$_o c_o a_o$CACctttaaaaccCCA | 757_2 | 746 |
| GN2-C6$_o c_o a_o$TCCtttataatcaCAC | 758_2 | 747 |
| GN2-C6$_o c_o a_o$ACGgtattttcacAGG | 759_2 | 748 |
| GN2-C6$_o c_o a_o$GACactacaatgaGGA | 760_2 | 749 |
| GN2-C6$_o c_o a_o$TGGtttttaggacTGT | 761_2 | 750 |
| GN2-C6$_o c_o a_o$CGAcaaattctatCCT | 762_2 | 751 |
| GN2-C6$_o c_o a_o$TGAtatacaatgcTAC | 763_2 | 752 |
| GN2-C6$_o c_o a_o$TCGttgggtaaatTTA | 764_2 | 753 |
| GN2-C6$_o c_o a_o$TGCtttataaatgGTG | 765_2 | 754 |
| GN2-C6$_o c_o a_o$ACAAataatggttaCTCT | 766_2 | 287 |
| GN2-C6$_o c_o a_o$CAGAttgatggtagTT | 767_2 | 342 |
| GN2-C6$_o c_o a_o$CCtatttaacatcAGAC | 768_2 | 640 |
| GN2-C6$_o c_o a_o$CTAattgtagtagtaCTC | 769_2 | 466 |
| GN2-C6$_o c_o a_o$ATaaacatgaatctCTCC | 770_2 | 566 |

GN2 represents the trivalent GalNAc cluster shown in FIG. 3, C6 represents an amino alkyl group with 6 carbons, capital letters represent beta-D-oxy LNA nucleosides, lowercase letters represent DNA nucleosides, all LNA C are 5-methyl cytosine, subscript o represent a phosphodiester nucleoside linkage and unless otherwise indicated internucleoside linkages are phosphorothioate internucleoside linkages. Chemical drawings representing some of the molecules are shown in FIGS. 4 to 8.

AAV/HBV Mouse Models
Pasteur Model:

HLA-A2.1-/HLA-DR1-transgenic H-2 class I—/class II- knockout (here referred to as HLA-A2/DR1) mice were created and bred at the Institut Pasteur. These mice represent an in vivo experimental model for human immune function studies without any interference with mouse MHC response (Pajot et al 2004 Eur J Immunol. 34 (11): 3060-9.

Adeno-associated virus (AAV) vector, AAV serotype 2/8 carrying a replication competent HBV DNA genome was used in these studies. The AAV-HBV vector (batch GVPN

6163) was diluted in sterile Phosphate buffered Saline (PBS) to reach a titer of $5 \times 10^{11}$ vg/mL. Mice were injected intravenously (i.v.) with 100 μL of this diluted solution (dose/mouse: $5 \times 10^{10}$ vg) in a tail vein. Complete viral particles containing HBV DNA were detected in the blood of HBV-carrier mice. HBcAg was detected for up to one year in the liver together with HBV circulating proteins HBeAg and HBsAg in the blood. In all AAV2/8-HBV-transduced mice, HBsAg, HBeAg, and HBV DNA persisted in serum for at least one year (Dion et al 2013 J Virol 87:5554-5563).

Shanghai Model:

In this model, mice infected with a recombinant adeno-associated virus (AAV) carrying the HBV genome (AAV/HBV) maintains stable viremia and antigenimia for more than 30 weeks (Dan Yang, et al. 2014 Cellular & Molecular Immunology 11, 71-78).

Male C57BL/6 mice (4-6 weeks old), specific pathogen free, were purchased from SLAC (Shanghai Laboratory Animal Center of Chinese Academy of Sciences) and housed in an animal care facility in individually ventilated cages. Guidelines were followed for the care and use of animals as indicated by WuXi IACUC (Institutional Animal Care and Use Committee, WUXI IACUC protocol number R20131126-Mouse). Mice were allowed to acclimate to the new environment for 3 days and are grouped according to the experimental design.

Recombinant AAV-HBV was diluted in PBS, 200 μL per injection. This recombinant virus carries 1.3 copies of the HBV genome (genotype D, serotype ayw).

On day 0, all mice were injected through tail vein with 200 μL AAV-HBV. On days 6, 13 and 20 after AAV injection, all mice in were submandibularly bled (0.1 ml blood/mouse) for serum collection. On day 22 post injection, mice with stable viremia were ready for oligonucleotide treatment. The oligonucleotides can be unconjugated or GalNAc conjugated.

DNA Vaccine

Plasmid DNA were endotoxin-free and manufactured by Plasmid-Factory (Germany). pCMV-S2.S ayw encodes the preS2 and S domains of the HBsAg (genotype D), and its expression is controlled by the cytomegalovirus immediate early gene promoter (Michel et al 1995 Proc Natl Acad Sci USA 92:5307-5311). pCMV-HBc encodes the HBV capsid carrying the hepatitis core (HBc) Ag (Dion et al 2013 J Virol 87:5554-5563).

Treatment with DNA vaccine was conducted as described here. Five days prior to vaccination cardiotoxine (CaTx, Latoxan refL81-02, 50 μl/muscle) was injected into the muscle of the mice. CaTx depolarizees the muscular fibers to induce cell degeneration, 5 days post injection, new muscular fibers will appear and will receive the DNA vaccine for a better efficacy for transfection. The pCMV-S2.S ayw and pCMVCore at 1 mg/ml each were mixed in equal amount and each mouse received a total of 100 μg by bilateral intramuscular injection into cardiotoxin-treated tibialis anterior muscles as previously described in Michel et al 1995 Proc Natl Acad Sci USA 92:5307-5311, under anesthesia (100 μL of 12.5 mg/mL ketamine, 1.25 mg/ml xylazine).

Anti-PD-L1 Antibody

This is a mouse anti mouse PD-L1 IgG1 antibody clone 6E11 internally produced at Genetech. It is a surrogate antibody that cross blocks Atezolizumab and has similar in vitro blocking activity Atezolizumabproduced internally at Roche. The antibody was adminstredadministered by intraperitoneal (i.p.) injection at a dose of 12.5 μg/g.

Oligonucleotide Synthesis

Oligonucleotide synthesis is generally known in the art. Below is a protocol which may be applied. The oligonucleotides of the present invention may have been produced by slightly varying methods in terms of apparatus, support and concentrations used.

Oligonucleotides are synthesized on uridine universal supports using the phosphoramidite approach on an Oligomaker 48 at 1 μmol scale. At the end of the synthesis, the oligonucleotides are cleaved from the solid support using aqueous ammonia for 5-16 hours at 60° C. The oligonucleotides are purified by reverse phase HPLC(RP-HPLC) or by solid phase extractions and characterized by UPLC, and the molecular mass is further confirmed by ESI-MS.

Elongation of the Oligonucleotide:

The coupling of β-cyanoethyl-phosphoramidites (DNA-A(Bz), DNA-G(ibu), DNA-C(Bz), DNA-T, LNA-5-methyl-C(Bz), LNA-A(Bz), LNA-G(dmf), or LNA-T) is performed by using a solution of 0.1 M of the 5'-O-DMT-protected amidite in acetonitrile and DCI (4,5-dicyanoimidazole) in acetonitrile (0.25 M) as activator. For the final cycle a phosphoramidite with desired modifications can be used, e.g. a C6 linker for attaching a conjugate group or a conjugate group as such. Thiolation for introduction of phosphorthioate linkages is carried out by using xanthane hydride (0.01 M in acetonitrile/pyridine 9:1). Phosphor diester linkages can be introduced using 0.02 M iodine in THF/Pyridine/water 7:2:1. The rest of the reagents are the ones typically used for oligonucleotide synthesis.

For post solid phase synthesis conjugation a commercially available C6 amino linker phosphoramidite can be used in the last cycle of the solid phase synthesis and after deprotection and cleavage from the solid support the amino linked deprotected oligonucleotide is isolated. The conjugates are introduced via activation of the functional group using standard synthesis methods.

Alternatively, the conjugate moiety can be added to the oligonucleotide while still on the solid support by using a GalNAc- or GalNAc-cluster phosphoramidite as described in PCT/EP2015/073331 or in EP Application Serial No. 15194811.4.

Purification by RP-HPLC:

The crude compounds are purified by preparative RP-HPLC on a Phenomenex Jupiter C18 10μ 150×10 mm column. 0.1 M ammonium acetate pH 8 and acetonitrile is used as buffers at a flow rate of 5 mL/min. The collected fractions are lyophilized to give the purified compound typically as a white solid.

ABBREVIATIONS

DCI: 4,5-Dicyanoimidazole
DCM: Dichloromethane
DMF: Dimethylformamide
DMT: 4,4'-Dimethoxytrityl
THF: Tetrahydrofurane
Bz: Benzoyl
Ibu: Isobutyryl
RP-HPLC: Reverse phase high performance liquid chromatography $T_m$ Assay Oligonucleotide and RNA target (phosphate linked, PO) duplexes are diluted to 3 mM in 500 ml RNase-free water and mixed with 500 ml $2 \times T_m$-buffer (200 mM NaCl, 0.2 mM EDTA, 20 mM Naphosphate, pH 7.0). The solution is heated to 95° C. for 3 min and then allowed to anneal in room temperature for 30 min. The duplex melting temperatures ($T_m$) is measured on a Lambda 40 UV/VIS Spectrophotometer equipped with a Peltier temperature programmer PTP6 using PE Templab software (Perkin Elmer). The temperature is ramped up from 20° C. to 95° C. and then down to 25° C., recording absorption at 260 nm. First derivative and the local maximums of both the melting and annealing are used to assess the duplex $T_m$.

Tissue Specific In Vitro Linker Cleavage Assay

FAM-labeled oligonucleotides with the biocleavable linker to be tested (e.g. a DNA phosphodiester linker (PO linker)) are subjected to in vitro cleavage using homogenates of the relevant tissues (e.g. liver or kidney) and Serum.

The tissue and serum samples are collected from a suitable animal (e.g. mice, monkey, pig or rat) and homogenized in a homogenisation buffer (0.5% Igepal CA-630, 25 mM Tris pH 8.0, 100 mM NaCl, pH 8.0 (adjusted with 1 N NaOH). The tissue homogenates and Serum are spiked with oligonucleotide to concentrations of 200 µg/g tissue. The samples are incubated for 24 hours at 37° C. and thereafter the samples are extracted with phenol-chloroform. The solutions are subjected to AIE HPLC analyses on a Dionex Ultimate 3000 using an Dionex DNApac p-100 column and a gradient ranging from 10 mM-1 M sodium perchlorate at pH 7.5. The content of cleaved and non-cleaved oligonucleotide are determined against a standard using both a fluorescence detector at 615 nm and a uv detector at 260 nm.

S1 Nuclease Cleavage Assay

FAM-labelled oligonucleotides with S1 nuclease susceptible linkers (e.g. a DNA phosphodiester linker (PO linker)) are subjected to in vitro cleavage in S1 nuclease extract or Serum.

100 µM of the oligonucleotides are subjected to in vitro cleavage by S1 nuclease in nuclease buffer (60 U pr. 100 µL) for 20 and 120 minutes. The enzymatic activity is stopped by adding EDTA to the buffer solution. The solutions are subjected to AIE HPLC analyses on a Dionex Ultimate 3000 using an Dionex DNApac p-100 column and a gradient ranging from 10 mM-1 M sodium perchlorate at pH 7.5. The content of cleaved and non-cleaved oligonucleotide is determined against a standard using both a fluorescence detector at 615 nm and a uv detector at 260 nm.

Preparation of Liver Mononuclear Cells

Liver cells from AAV/HBV mice were prepared as described below and according to a method described by Tupin et al 2006 Methods Enzymol 417:185-201 with minor modifications. After mouse euthanasia, the liver was perfused with 10 ml of sterile PBS via hepatic portal vein using syringe with $G_{25}$ needle. When organ is pale, the organ was harvested in Hank's Balanced Salt Solution (HBSS) (GIBCOR HBSS, 24020)+5% decomplemented fetal calf serum (FCS). The harvested liver was gently pressed through 100 µm cell-strainer (BD Falcon, 352360) and cells were suspended in 30 ml of HBSS+5% FCS. Cell suspension was centrifuged at 50 g for 5 min. Supernatants were then centrifuged at 289 g for 10 min at 4° C. After centrifugation, supernatants were discarded and pellets were re-suspended in 15 mL at room temperature in a 35% isotonic Percoll solution (GE Healthcare Percoll #17-0891-01 diluted into RPMI 1640 (GIBCO, 31870)) and transferred to a 15 ml tube. Cells were further centrifuged at 1360 g for 25 min at room temperature. The supernatant was discarded by aspiration and the pellet containing mononuclear cells was washed twice with HBSS+5% FCS.

Cells were cultured in complete medium (a-minimal essential medium (Gibco, 22571) supplemented with 10% FCS (Hyclone, #SH30066, lot APG21570), 100 U/mL penicillin+100 µg/mL streptomycin+0.3 mg/mL L-glutamine (Gibco, 10378), 1× non-essential amino acids (Gibco, 11140), 10 mM Hepes (Gibco, 15630), 1 mM sodium pyruvate (Gibco, 11360) and 50 µM β-mercaptoethanol (LKB, 1830)).

Surface Labeling of Cells

Cells were seeded in U-bottom 96-well plates and washed with PBS FACS (PBS containing 1% bovine serum albumin and 0.01% sodium azide). Cells were incubated with 5 µL of PBS FACS containing a rat anti-mouse CD16/CD32 antibody and a viability marker LD fixable yellow, Thermofisher, L34959 for 10 min in the dark at 4° C. Then, cells were stained for 20 min in the dark at 4° C. with 25 µL of PBS FACS containing monoclonal antibodies (Mab) against NK P46 BV421 (Rat Mab anti mouse NK P46, Biolegend, 137612) and $F_{4/80}$ (rat Mab anti-mouse $F_{4/80}$ FITC, BD Biolegend, 123108) and two supplemental surface markers: PD1 (rat Mab anti-mouse PD1 PE, BD Biosciences, 551892) and PDL1 (rat Mab anti-mouse PDL1 BV711, Biolegend, 124319) were also added.

Intracelluar Cytokine Staining (ICS) Assay

ICS assays were performed on both splenocytes and liver mononuclear cells. Cells were seeded in Ubottom 96-well plates. Plates with cells were incubated overnight at 37° C. either in complete medium alone as negative control or with the peptides described in Table 9 at a concentration of 2 µg/ml. Brefeldin A at 2 µg/mL (Sigma, B6542) was added after one hour of incubation.

After the overnight culture, cells were washed with PBS FACS and incubated with 5 µL of PBS FACS containing rat anti-mouse CD16/CD32 antibody and a viability marker LD fixable yellow, Thermofisher, L34959 for 10 min in the dark at 4° C. Then, cells were stained for 20 min in the dark at 4° C. with 25 µL of PBS FACS containing Mab. The mix was composed of monoclonal antibodies against CD3 (hamster Mab anti-mouse CD3-PerCP, BD Biosciences, 553067), CD8 (rat Mab anti-mouse CD8-APC-H7, BD Biosciences, 560182), CD4 (rat Mab anti-mouse CD4-PE-Cy7, BD Biosciences, 552775), and NK cells (Rat Mab anti mouse NK P46 BV421, Biolegend, 137612). Cells were fixed after several washes and permeabilized for 20 min in the dark at room temperature with Cytofix/Cytoperm, washed with Perm/Wash solution (BD Biosciences, 554714) at 4° C.

Intracellular cytokine staining with antibodies against IFNγ (rat Mab anti-mouse IFNγ-APC, clone XMG1.2, BD Biosciences, 554413) and tumor necrosis factor alpha (TNFα) (rat Mab anti-mouse TNFα-FITC, clone MP6-XT22; 1/250 (BD Biosciences 554418) was performed for 30 min in the dark at 4° C. Before analysis by flow cytometry using the MACSQuant Analyzer, cells were washed with Perm/Wash and re-suspended in PBS FACS containing 1% Formaldehyde.

Live CD3+CD8+CD4− and cells CD3+CD8−CD4+ were gated and presented on dot-plot. Two regions were defined to gate for positive cells for each cytokine. Numbers of events found in these gates were divided by total number of events in parental population to yield percentages of responding T cells. For each mouse, the percentage obtained in medium alone was considered as background and subtracted from the percentage obtained with peptide stimulations.

Threshold of positivity was defined according to experiment background i.e. the mean percentage of stained cells obtained for each group in medium alone condition plus two standard deviations. Only percentage of cytokine represented at least 5 events were considered as positive.

TABLE 9

HLA-A2/DR1 restricted epitopes contained in the HBV Core protein and the Envelope domains of the HBsAg (S2 + S).

| Protein | Start Position | End Position | Sequence | HLA restriction | References |
|---|---|---|---|---|---|
| Core | 18 | 27 | FLPSDFFPSV (SEQ ID NO: 773) | A2 | Bertoletti et al Gastroenterology 1997; 112: 193-199 |
| | 111 | 125 | GRETVLEYLVSFGVW (SEQ ID NO: 774) | DR1 | (Bertoletti et al Gastroenterology 1997; 112: 193-199 |
| Envelope (S2 + S) | 114 | 128 | TTFHQTLQDPRVRGL (SEQ ID NO: 775) | DR1 | Pajot et al Microbes Infect 2006;8:2783-2790. |
| | 179 | 194 | QAGFFLLTRILTIPQS (SEQ ID NO: 776) | A2 + DR1 | Pajot et al Microbes Infect 2006;8:2783-2790. |
| | 183 | 191 | FLLTRILTI (SEQ ID NO: 777) | A2 | Sette et al J Immunol 1994; 153: 5586-5592. |
| | 200 | 214 | TSLNFLGGTTVCLGQ (SEQ ID NO: 778) | A2 + DR1 | Pajot et al Microbes Infect 2006; 8: 2783-2790. |
| | 204 | 212 | FLGGTTVCL (SEQ ID NO: 779) | A2 | Rehermann et al J Exp Med 1995; 181: 1047-1058. |
| | 335 | 343 | WLSLLVPFV (SEQ ID NO: 780) | A2 | Nayersina et al J Immunol 1993; 150: 4659-4671. |
| | 337 | 357 | SLLVPFVQWFVGLSPTVWLSV (SEQ ID NO: 781) | A2 + DR1 | Loirat et al J Immunol 2000; 165: 4748-4755 |
| | 348 | 357 | GLSPTVWLSV (SEQ ID NO: 782) | A2 | Loirat et al J Immunol 2000; 165: 4748-4755 |
| | 370 | 379 | SILSPFLPLL (SEQ ID NO: 783) | A2 | Mizukoshi et al J Immunol 2004; 173: 5863-5871. |

Example 1 Testing In Vitro Efficacy

A gene walk was performed across the human PD-L1 transcript primarily using 16 to 20mer gapmers. Efficacy testing was performed in an in vitro experiment in the human leukemia monocytic cell line THP1 and in the human non-Hodgkin's K lymphoma cell line (KARPAS-299).

Cell Lines

THP1 and Karpas-299 cell line were originally purchased from European Collection of Authenticated Cell Cultures (ECACC) and maintained as recommended by the supplier in a humidified incubator at 37° C. with 5% $CO_2$.

Oligonucleotide Efficacy

THP-1 cells (3.104 in RPMI-GLutamax, 10% FBS, 1% Pen-Strep (Thermo Fisher Scientific) were added to the oligonucleotides (4-5 ul) into 96-well round bottom plates and cultured for 6 days in a final volume of 100 µl/well. Oligonucleotides were screened at one single concentration (20 µM) and in dose-range concentrations from 25 µM to 0.004 µM (1:3 dilution in water). Total mRNA was extracted using the MagNA Pure 96 Cellular RNA Large Volume Kit on the MagNA Pure 96 System (Roche Diagnostics) according to the manufacturer's instructions. For gene expression analysis, RT-qPCR was performed using the TaqMan RNA-to-ct 1-Step kit (Thermo Fisher Scientific) on the QuantStudio machine (Applied Biosystems) with pre-designed Taqman primers targeting human PDL1 and ACTB used as endogenous control (Thermo Fisher Scientific). The relative PD-L1 mRNA expression level was calculated using 2 (-Delta Delta C(T)) method and the percentage of inhibition as the % compared to the control sample (non-treated cells).

Karpas-299 cells were cultured in RPMI 1640, 2 mM Glutamine and 20% FBS (Sigma). The cells were plated at 10000 cell/well in 96 wells plates incubated for 24 hours before addition of oligonucleotides dissolved in PBS. Final concentration of oligonucleotides was in a single dose of 5 µM, in a final culture volume was 100 µl/well or added in a dose response ranging from 50 µM, 15.8 µM, 5.0 µM, 1.58 µM, 0.5 µM, 0.158 µM, 0.05 µM, to 0.0158 µM in 100 UL culture volume. The cells were harvested 3 days after addition of oligonucleotide compounds and RNA was extracted using the PureLink Pro 96 RNA Purification kit (Ambion), according to the manufacturer's instructions. cDNA was synthesized using M-MLT Reverse Transcriptase, random decamers RETROscript, RNase inhibitor (Ambion) and 100 mM dNTP set (Invitrogen, PCR Grade) according to the manufacturer's instruction. For gene expressions analysis, qPCR was performed using TaqMan Fast Advanced Master Mix (2×) (Ambion) in a duplex set up with TaqMan primer assays for the PD-L1 (Applied Biosystems; Hs01125299_m1) and TBP(Applied Biosystems; 4325803). The relative PD-L1 mRNA expression level is shown in table 10 as % of control sample (PBS-treated cells).

TABLE 10 in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
|---|---|---|---|---|---|---|---|
| | % mRNA of control | sd | % mRNA of control | sd | | | |
| 4_1 | 50 | 1 | 32 | 11 | TAattggctctacTGC | 236 | 5 |
| 5_1 | 25 | 5 | 9 | 6 | TCGCataagaatgaCT | 371 | 6 |
| 6_1 | 29 | 2 | 15 | 5 | TGaacacacagtcgCA | 382 | 7 |
| 7_1 | 27 | 7 | 3 | 1 | CTGaacacacagtCGC | 383 | 8 |
| 8_1 | 23 | 4 | 11 | 3 | TCTgaacacacagtCG | 384 | 9 |
| 9_1 | 32 | 3 | 19 | 6 | TTCtgaacacacagTC | 385 | 10 |
| 10_1 | 57 | 5 | 39 | 16 | ACaagtcatgttaCTA | 463 | 11 |
| 11_1 | 75 | 5 | 37 | 12 | ACacaagtcatgttAC | 465 | 12 |
| 12_1 | 22 | 2 | 10 | 3 | CTtacttagatgcTGC | 495 | 13 |
| 13_1 | 33 | 4 | 23 | 11 | ACttacttagatgCTG | 496 | 14 |
| 14_1 | 33 | 7 | 21 | 6 | GACttacttagatgCT | 497 | 15 |
| 15_1 | 41 | 6 | 18 | 10 | AGacttacttagaTGC | 498 | 16 |
| 16_1 | 96 | 14 | 40 | 7 | GCAggaagagactTAC | 506 | 17 |
| 17_1 | 22 | 2 | 9 | 3 | AATAaattccgttCAGG | 541 | 18 |
| 18_1 | 34 | 6 | 21 | 9 | GCAAataaattcCGTT | 545 | 19 |
| 18_2 | 51 | 4 | 27 | 11 | GCAaataaattccGTT | 545 | 19 |
| 19_1 | 38 | 5 | 23 | 7 | AGCAaataaattcCGT | 546 | 20 |
| 20_1 | 73 | 8 | 56 | 15 | CAGAgcaaataaatTCC | 548 | 21 |
| 21_1 | 83 | 8 | 65 | 10 | TGGAcagagcaaataAAT | 551 | 22 |
| 22_1 | 86 | 6 | 80 | 8 | ATGGacagagcaAATA | 554 | 23 |
| 23_1 | 44 | 4 | 30 | 2 | CAgaatggacagaGCA | 558 | 24 |
| 24_1 | 63 | 10 | 40 | 11 | TTCtcagaatggacAG | 562 | 25 |
| 25_1 | 31 | 1 | 39 | 5 | CTGAactttgacATAG | 663 | 26 |
| 26_1 | 60 | 4 | 56 | 19 | AAgacaaacccagacTGA | 675 | 27 |
| 27_1 | 36 | 4 | 34 | 10 | TATAagacaaacccAGAC | 678 | 28 |
| 28_1 | 40 | 4 | 28 | 13 | TTATaagacaaaccCAGA | 679 | 29 |
| 29_1 | 30 | 2 | 18 | 6 | TGTTataagacaaaCCC | 682 | 30 |
| 30_1 | 77 | 3 | 67 | 10 | TAGAacaatggtaCTTT | 708 | 31 |
| 31_1 | 81 | 17 | 20 | 14 | GTAGaacaatggtaCT | 710 | 32 |
| 32_1 | 29 | 5 | 14 | 8 | AGGtagaacaatgGTA | 712 | 33 |
| 33_1 | 32 | 1 | 43 | 20 | AAGAggtagaacaATGG | 714 | 34 |
| 34_1 | 70 | 4 | 35 | 13 | GCatccacagtaaaTT | 749 | 35 |
| 35_1 | 83 | 2 | 66 | 21 | GAaggttatttaaTTC | 773 | 36 |
| 36_1 | 18 | 2 | 15 | 5 | CTAAtcgaatgcaGCA | 805 | 37 |
| 37_1 | 64 | 7 | 35 | 10 | TACccaatctaatCGA | 813 | 38 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
|---|---|---|---|---|---|---|---|
| | % mRNA of control | sd | % mRNA of control | sd | | | |
| 38_1 | 69 | 1 | 49 | 13 | TAGttacccaatcTAA | 817 | 39 |
| 39_1 | 49 | 5 | 26 | 9 | CATttagttacccAAT | 821 | 40 |
| 40_1 | 23 | 7 | 8 | 2 | TCAtttagttaccCAA | 822 | 41 |
| 41_1 | 24 | 6 | 12 | 3 | TTcatttagttaCCCA | 823 | 42 |
| 42_1 | 51 | 7 | 40 | 5 | GAATtaatttcattTAGT | 829 | 43 |
| 43_1 | 71 | 9 | 45 | 3 | CAGTgaggaattaATTT | 837 | 44 |
| 44_1 | 60 | 5 | 45 | 17 | CCAAcagtgaggAATT | 842 | 45 |
| 45_1 | 63 | 1 | 37 | 15 | CCCaacagtgaggAAT | 843 | 46 |
| 46_1 | 31 | 3 | 29 | 12 | TAtacccaacagtgAGG | 846 | 47 |
| 47_1 | 44 | 3 | 27 | 0 | TTatacccaacagTGAG | 847 | 48 |
| 48_1 | 38 | 3 | 26 | 6 | TTTatacccaacagTGA | 848 | 49 |
| 49_1 | 20 | 4 | 7 | 1 | CCTttatacccaaCAG | 851 | 50 |
| 50_1 | 22 | 3 | 6 | 2 | TAACctttatacCCAA | 854 | 51 |
| 51_1 | 28 | 1 | 29 | 16 | AATaacctttataCCCA | 855 | 52 |
| 52_1 | 80 | 11 | 48 | 10 | GTAaataaccttaTA | 859 | 53 |
| 53_1 | 54 | 4 | 37 | 14 | ACTGtaaataaccaTAT | 860 | 54 |
| 54_1 | 81 | 4 | 53 | 15 | ATAtatatgcaatgAG | 903 | 55 |
| 55_1 | 86 | 12 | 70 | 15 | AGatatatatgcaaTG | 905 | 56 |
| 56_1 | 56 | 8 | 27 | 7 | GAGatatatatgcAAT | 906 | 57 |
| 57_1 | 28 | 7 | 13 | 5 | CCagagatatataTGC | 909 | 58 |
| 58_1 | 88 | 13 | 69 | 23 | CAATattccagagATAT | 915 | 59 |
| 59_1 | 29 | 3 | 14 | 6 | GCAatattccagagATA | 916 | 60 |
| 60_1 | 25 | 3 | 14 | 3 | AGCaatattccagaGAT | 917 | 61 |
| 61_1 | 29 | 4 | 17 | 2 | CAGcaatattccAGAG | 919 | 62 |
| 62_1 | 27 | 3 | 14 | 3 | AATCagcaatattCCAG | 921 | 63 |
| 63_1 | 23 | 6 | 12 | 6 | ACAAtcagcaataTTCC | 923 | 64 |
| 64_1 | 53 | 9 | 43 | 15 | ACtaagtagttacactTCT | 957 | 65 |
| 65_1 | 32 | 5 | 14 | 6 | CTAAgtagttacactTC | 958 | 66 |
| 66_1 | 35 | 4 | 31 | 6 | GACtaagtagttacaCTT | 959 | 67 |
| 67_1 | 64 | 10 | 55 | 14 | TGActaagtagtTACA | 962 | 68 |
| 68_1 | 62 | 11 | 57 | 16 | CTTTgactaagtagTTA | 964 | 69 |
| 69_1 | 42 | 9 | 59 | 13 | CTCtttgactaagTAG | 967 | 70 |
| 70_1 | 81 | 6 | 56 | 12 | GCTCtttgactaagTA | 968 | 71 |
| 71_1 | 27 | 3 | 39 | 9 | CCttaaatactgtTGAC | 1060 | 72 |
| 72_1 | 75 | 5 | 36 | 7 | CTtaaatactgttgAC | 1060 | 73 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
| | % mRNA of control | sd | % mRNA of control | sd | | | |
|---|---|---|---|---|---|---|---|
| 73_1 | 35 | 6 | 43 | 13 | TCCttaaatactgTTG | 1062 | 74 |
| 74_1 | 57 | 4 | 79 | 25 | TCTCcttaaatactgTT | 1063 | 75 |
| 75_1 | 53 | 6 | 28 | 6 | TAtcatagttctCCTT | 1073 | 76 |
| 76_1 | 26 | 4 | 9 | 2 | AGTatcatagttcTCC | 1075 | 77 |
| 77_1 | 74 | 5 | 39 | 12 | GAgtatcatagttCTC | 1076 | 78 |
| 78_1 | 49 | 5 | 35 | 6 | AGagtatcatagTTCT | 1077 | 79 |
| 78_2 | 74 | 6 | 36 | 8 | AGAgtatcatagtTCT | 1077 | 79 |
| 79_1 | 19 | 2 | 19 | 13 | CAGagtatcatagTTC | 1078 | 80 |
| 80_1 | 23 | 2 | 26 | 2 | TTCAgagtatcataGT | 1080 | 81 |
| 81_1 | 35 | 3 | 36 | 11 | CTTcagagtatcATAG | 1081 | 82 |
| 82_1 | 24 | 6 | 20 | 7 | TTCTtcagagtatcaTA | 1082 | 83 |
| 83_1 | 20 | 2 | 16 | 2 | TTTcttcagagtaTCAT | 1083 | 84 |
| 84_1 | 33 | 4 | 37 | 10 | GAGAaaggctaagTTT | 1099 | 85 |
| 85_1 | 42 | 2 | 35 | 18 | GAcactcttgtaCATT | 1213 | 86 |
| 86_1 | 50 | 4 | 54 | 8 | TGagacactcttgtaCA | 1215 | 87 |
| 87_1 | 50 | 8 | 28 | 8 | TGagacactcttgTAC | 1216 | 88 |
| 88_1 | 61 | 4 | 33 | 6 | CTttattaaactCCAT | 1266 | 89 |
| 89_1 | 71 | 8 | 43 | 12 | ACCAaactttattaAA | 1272 | 90 |
| 90_1 | 62 | 5 | 42 | 9 | AAACctctactaagTG | 1288 | 91 |
| 91_1 | 22 | 3 | 12 | 5 | AGattaagacagtTGA | 1310 | 92 |
| 92_1 | 46 | 3 | ND | ND | AAgtaggagcaagaGGC | 1475 | 93 |
| 93_1 | 42 | 4 | 60 | 24 | AAAGtaggagcaagAGG | 1476 | 94 |
| 94_1 | 86 | 15 | 46 | 10 | GTtaagcagccaggAG | 1806 | 95 |
| 95_1 | 66 | 6 | 82 | 27 | AGggtaggatggtAG | 1842 | 96 |
| 96_1 | 83 | 19 | 62 | 36 | AAGggtaggatgggTA | 1843 | 97 |
| 97_1 | 60 | 9 | 69 | 5 | CAAgggtaggatggGT | 1844 | 98 |
| 97_2 | 76 | 13 | 34 | 7 | CAagggtaggatggGT | 1844 | 98 |
| 98_1 | 65 | 8 | 76 | 28 | CCaagggtaggatgGG | 1845 | 99 |
| 99_1 | 61 | 2 | 75 | 17 | TCcaagggtaggatGG | 1846 | 100 |
| 100_1 | 83 | 4 | 82 | 13 | CTTCcaagggtaggAT | 1848 | 101 |
| 101_1 | 45 | 3 | 52 | 14 | ATCttccaagggtagGA | 1849 | 102 |
| 102_1 | 29 | 2 | 17 | 7 | AGaagtgatggctCATT | 1936 | 103 |
| 103_1 | 26 | 3 | 22 | 1 | AAGaagtgatggcTCAT | 1937 | 104 |
| 104_1 | 34 | 6 | 22 | 2 | GAAgaagtgatggcTCA | 1938 | 105 |
| 105_1 | 41 | 5 | 21 | 5 | ATGAaatgtaaacTGGG | 1955 | 106 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
|---|---|---|---|---|---|---|---|
| | % mRNA of control | sd | % mRNA of control | sd | | | |
| 106_1 | 40 | 8 | 29 | 6 | CAATgaaatgtaaaCTGG | 1956 | 107 |
| 107_1 | 24 | 3 | 16 | 4 | GCAAtgaaatgtaaACTG | 1957 | 108 |
| 108_1 | 30 | 4 | 20 | 6 | AGCAatgaaatgtaAACT | 1958 | 109 |
| 109_1 | 44 | 4 | 34 | 14 | GAGCaatgaaatgtAAAC | 1959 | 110 |
| 110_1 | 18 | 1 | 13 | 3 | TGaattcccatatcCGA | 1992 | 111 |
| 111_1 | 69 | 8 | 35 | 8 | AGaattatgaccaTAT | 2010 | 112 |
| 112_1 | 77 | 7 | 38 | 10 | AGGtaagaattatGACC | 2014 | 112 |
| 113_1 | 97 | 10 | 56 | 13 | TCAGgtaagaattaTGAC | 2015 | 114 |
| 114_1 | 69 | 8 | 54 | 21 | CTTCaggtaagaatTATG | 2017 | 115 |
| 115_1 | 91 | 7 | 115 | 42 | TCTTcaggtaagaATTA | 2019 | 116 |
| 116_1 | 88 | 6 | 104 | 36 | CTTCttcaggtaaGAAT | 2021 | 117 |
| 117_1 | 85 | 6 | 118 | 17 | TCTTcttcaggtaAGAA | 2022 | 118 |
| 118_1 | 105 | 14 | 102 | 9 | TCTtcttcaggtaAGA | 2023 | 119 |
| 119_1 | 37 | 2 | 76 | 18 | TGGtctaagagaaGAAG | 2046 | 120 |
| 120_1 | 46 | 6 | 81 | 11 | GTTGgtctaagagAAG | 2049 | 121 |
| 121_1 | 74 | 11 | 64 | 4 | AGTtggtctaagAGAA | 2050 | 122 |
| 122_1 | 74 | 9 | 55 | 21 | CAgttggtctaagAGAA | 2050 | 123 |
| 123_1 | 65 | 9 | 95 | 21 | GCAgttggtctaagagAA | 2050 | 124 |
| 124_1 | 63 | 7 | ND | ND | CAGTtggtctaagaGA | 2051 | 125 |
| 125_1 | 65 | 6 | ND | ND | GCagttggtctaagaGA | 2051 | 126 |
| 126_1 | 67 | 14 | 104 | 34 | GCagttggtctaaGAG | 2052 | 127 |
| 127_1 | 22 | 6 | 10 | 3 | CTcatatcagggCAGT | 2063 | 128 |
| 128_1 | 50 | 4 | 46 | 9 | CACAcatgttctttaAC | 2087 | 129 |
| 129_1 | 22 | 4 | 12 | 12 | TAAatacacacatgTTCT | 2092 | 130 |
| 130_1 | 24 | 2 | 43 | 28 | GTAAatacacacatgTTC | 2093 | 131 |
| 131_1 | 33 | 3 | 20 | 12 | TGTAaatacacacaTGTT | 2094 | 132 |
| 132_1 | 73 | 17 | 57 | 21 | GATCatgtaaatacACAC | 2099 | 133 |
| 133_1 | 47 | 5 | 28 | 14 | AGATcatgtaaataCACA | 2100 | 134 |
| 134_1 | 35 | 6 | 26 | 11 | CAAAgatcatgtaaatACAC | 2101 | 135 |
| 135_1 | 30 | 2 | 14 | 3 | ACAAagatcatgtaaaTACA | 2102 | 136 |
| 136_1 | 52 | 6 | 24 | 18 | GAATacaaagatcaTGTA | 2108 | 137 |
| 137_1 | 33 | 5 | 20 | 6 | AGAAtacaaagatcATGT | 2109 | 138 |
| 138_1 | 37 | 1 | 22 | 15 | CAGAatacaaagatCATG | 2110 | 139 |
| 139_1 | 85 | 6 | 53 | 8 | GCAGaatacaaagATCA | 2112 | 140 |
| 140_1 | 79 | 4 | 40 | 6 | AGGCagaatacaaagAT | 2114 | 141 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
| --- | --- | --- | --- | --- | --- | --- | --- |
| | % mRNA of control | sd | % mRNA of control | sd | | | |
| 141_1 | 56 | 2 | 53 | 20 | AAGGcagaatacaaAGA | 2115 | 142 |
| 142_1 | 28 | 5 | 20 | 5 | ATTagtgagggacGAA | 2132 | 143 |
| 143_1 | 26 | 2 | 22 | 10 | CAttagtgagggaCGA | 2133 | 144 |
| 144_1 | 29 | 6 | 16 | 4 | GAgggtgatggatTAG | 2218 | 145 |
| 145_1 | 45 | 6 | 22 | 5 | TTaggagtaataAAGG | 2241 | 146 |
| 146_1 | 65 | 7 | 44 | 9 | TTAatgaatttggtTG | 2263 | 147 |
| 147_1 | 84 | 8 | 43 | 10 | CTttaatgaatttgGT | 2265 | 148 |
| 148_1 | 32 | 0 | 15 | 3 | CATGgattacaactAA | 2322 | 149 |
| 149_1 | 33 | 2 | 20 | 4 | TCatggattacaaCTA | 2323 | 150 |
| 150_1 | 29 | 1 | 11 | 3 | GTCatggattacaaCT | 2324 | 151 |
| 151_1 | 64 | 2 | 40 | 9 | CAttaaatctagTCAT | 2335 | 152 |
| 152_1 | 97 | 8 | 63 | 22 | GACAttaaatctagTCA | 2336 | 153 |
| 153_1 | 92 | 7 | ND | ND | AGGGacattaaatcTA | 2340 | 154 |
| 154_1 | 35 | 4 | 25 | 15 | CAAAgcattataaCCA | 2372 | 155 |
| 155_1 | 34 | 3 | 24 | 6 | ACttactaggcaGAAG | 2415 | 156 |
| 156_1 | 102 | 6 | 113 | 18 | CAGAgttaactgtaCA | 2545 | 157 |
| 157_1 | 102 | 10 | 103 | 15 | CCAGagttaactgtAC | 2546 | 158 |
| 158_1 | 88 | 7 | 95 | 18 | GCcagagttaactgTA | 2547 | 159 |
| 159_1 | 78 | 10 | ND | ND | TGggccagagttaaCT | 2550 | 160 |
| 160_1 | 59 | 5 | 26 | 5 | CAgcatctatcagaCT | 2576 | 161 |
| 161_1 | 78 | 8 | 42 | 10 | TGAaataacatgagTCAT | 2711 | 162 |
| 162_1 | 31 | 6 | ND | ND | GTGaaataacatgAGTC | 2713 | 163 |
| 163_1 | 18 | 2 | 11 | 3 | TCTGtttatgtcacTG | 2781 | 164 |
| 164_1 | 56 | 5 | 29 | 9 | GTCTgtttatgtcaCT | 2782 | 165 |
| 165_1 | 37 | 8 | 12 | 5 | TGgtctgtttatGTCA | 2784 | 166 |
| 166_1 | 39 | 1 | 19 | 3 | TTGGtctgtttatgTC | 2785 | 167 |
| 167_1 | 41 | 3 | 35 | 14 | TCacccattgtttaAA | 2842 | 168 |
| 168_1 | 18 | 3 | 14 | 4 | TTcagcaaatatTCGT | 2995 | 169 |
| 169_1 | 36 | 8 | 13 | 2 | GTGtgttcagcaaATAT | 2999 | 170 |
| 170_1 | 18 | 2 | 11 | 4 | TCTattgttaggtATC | 3053 | 171 |
| 171_1 | 67 | 4 | 26 | 12 | ATtgcccatcttacTG | 3118 | 172 |
| 172_1 | 71 | 2 | 33 | 9 | TATtgcccatcttaCT | 3119 | 173 |
| 173_1 | 47 | 4 | 20 | 5 | AAatattgcccatCTT | 3122 | 174 |
| 174_1 | 74 | 4 | 34 | 7 | ATAaccttatcataCA | 3174 | 175 |
| 175_1 | 98 | 19 | 44 | 12 | TAtaaccttatcaTAC | 3175 | 176 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| | KARPAS-299 cells 5 µM CMP | | THP1 cells 20 µM CMP | | | Start on | SEQ |
|---|---|---|---|---|---|---|---|
| CMP ID NO | % mRNA of control | sd | % mRNA of control | sd | Compound (CMP) | SEQ ID NO 1 | ID NO |
| 176_1 | 100 | 10 | 64 | 11 | TTAtaaccttatcaTA | 3176 | 177 |
| 177_1 | 72 | 38 | 28 | 5 | TTTataaccttatCAT | 3177 | 178 |
| 178_1 | 47 | 6 | 34 | 6 | ACtgctattgctaTCT | 3375 | 179 |
| 179_1 | 41 | 3 | 23 | 6 | AGgactgctattgCTA | 3378 | 180 |
| 180_1 | 32 | 6 | 27 | 7 | GAGgactgctattgCT | 3379 | 181 |
| 181_1 | 83 | 1 | 46 | 20 | ACgtagaataataaCA | 3561 | 182 |
| 182_1 | 94 | 4 | 52 | 9 | CCaagtgatataATGG | 3613 | 183 |
| 183_1 | 49 | 2 | 16 | 3 | TTagcagaccaaGTGA | 3621 | 184 |
| 184_1 | 96 | 3 | 26 | 5 | GTttagcagaccaaGT | 3623 | 185 |
| 185_1 | 78 | 3 | 46 | 10 | TGacagtgattataTT | 3856 | 186 |
| 186_1 | 88 | 5 | 45 | 21 | TGTCcaagatattgAC | 3868 | 187 |
| 187_1 | 46 | 6 | 23 | 6 | GAAtatcctagatTGT | 4066 | 188 |
| 188_1 | 79 | 3 | 45 | 14 | CAaactgagaataTCC | 4074 | 189 |
| 189_1 | 63 | 5 | 27 | 8 | GCAaactgagaataTC | 4075 | 190 |
| 190_1 | 77 | 9 | 37 | 11 | TCCtattacaatcgTA | 4214 | 191 |
| 191_1 | 74 | 10 | 36 | 9 | TTCCtattacaatcGT | 4215 | 192 |
| 192_1 | 91 | 8 | 51 | 28 | ACtaatgggaggatTT | 4256 | 193 |
| 193_1 | 95 | 14 | 67 | 24 | TAgttcagagaataAG | 4429 | 194 |
| 194_1 | 86 | 5 | 47 | 16 | TAacatatagttcAGA | 4436 | 195 |
| 195_1 | 87 | 4 | 81 | 20 | ATAacatatagttcAG | 4437 | 196 |
| 196_1 | 101 | 6 | 67 | 20 | CAtaacatatagttCA | 4438 | 197 |
| 197_1 | 91 | 6 | 60 | 13 | TCataacatatagtTC | 4439 | 198 |
| 198_1 | 61 | 3 | 31 | 10 | TAGCtcctaacaatCA | 4507 | 199 |
| 199_1 | 79 | 12 | 49 | 11 | CTCCaatctttgtaTA | 4602 | 200 |
| 200_1 | 74 | 2 | 58 | 13 | TCTCcaatctttgtAT | 4603 | 201 |
| 201_1 | 53 | 3 | 33 | 10 | TCtatttcagccaaTC | 4708 | 202 |
| 202_1 | 25 | 4 | 30 | 9 | CGGaagtcagagtGAA | 4782 | 203 |
| 203_1 | 32 | 5 | 21 | 7 | TTAAgcatgaggaaTA | 4798 | 204 |
| 204_1 | 34 | 10 | 26 | 11 | TGAttgagcacctCTT | 4831 | 205 |
| 205_1 | 81 | 12 | 62 | 12 | GACtaattatttcgTT | 4857 | 206 |
| 206_1 | 57 | 7 | 37 | 7 | TGActaattatttCGT | 4858 | 207 |
| 207_1 | 26 | 5 | 21 | 6 | GTGactaattattTCG | 4859 | 208 |
| 208_1 | 48 | 3 | 33 | 13 | CTGCttgaaatgtgAC | 4870 | 209 |
| 209_1 | 32 | 1 | 34 | 13 | CCtgcttgaaatgTGA | 4871 | 210 |
| 210_1 | 60 | 5 | 50 | 19 | ATcctgcttgaaATGT | 4873 | 211 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
|---|---|---|---|---|---|---|---|
| | % mRNA of control | sd | % mRNA of control | sd | | | |
| 211_1 | 111 | 8 | 110 | 26 | ATTataaatctatTCT | 5027 | 212 |
| 212_1 | 107 | 1 | 67 | 12 | GCtaaatactttcATC | 5151 | 213 |
| 213_1 | 26 | 3 | 19 | 6 | CAttgtaacataCCTA | 5251 | 214 |
| 214_1 | 33 | 2 | 20 | 4 | GCattgtaacatacCT | 5252 | 215 |
| 215_1 | 89 | 8 | 53 | 16 | TAatattgcaccaaAT | 5295 | 216 |
| 216_1 | 25 | 2 | 29 | 9 | GAtaatattgcacCAA | 5297 | 217 |
| 217_1 | 27 | 1 | 27 | 6 | AGataatattgcacCA | 5298 | 218 |
| 218_1 | 79 | 6 | 45 | 11 | GCcaagaagataATAT | 5305 | 219 |
| 219_1 | 159 | 16 | 68 | 14 | CACAgccacataaaCT | 5406 | 220 |
| 220_1 | 90 | 2 | 72 | 12 | TTgtaattgtggaaAC | 5463 | 221 |
| 221_1 | 10 | 2 | 11 | 5 | TGacttgtaattgTGG | 5467 | 222 |
| 222_1 | 82 | 1 | 67 | 18 | TCtaactgaaatagTC | 5503 | 223 |
| 223_1 | 30 | 1 | 32 | 9 | GTGgttctaactgaAA | 5508 | 224 |
| 224_1 | 53 | 7 | 53 | 15 | CAatatgggacttgGT | 5522 | 225 |
| 225_1 | 44 | 1 | 33 | 10 | ATGacaatatgggaCT | 5526 | 226 |
| 226_1 | 49 | 1 | 41 | 14 | TATGacaatatgggAC | 5527 | 227 |
| 227_1 | 77 | 1 | 54 | 15 | ATATgacaatatggGA | 5528 | 228 |
| 228_1 | 100 | 3 | 98 | 29 | CTtcacttaataaTTA | 5552 | 229 |
| 229_1 | 90 | 12 | 80 | 19 | CTGCttcacttaatAA | 5555 | 230 |
| 230_1 | 91 | 0 | 79 | 23 | AAgactgcttcacTTA | 5559 | 231 |
| 231_1 | 49 | 8 | 77 | 34 | GAATgccctaattaTG | 5589 | 232 |
| 232_1 | 17 | 7 | 88 | 33 | TGGaatgccctaatTA | 5591 | 233 |
| 233_1 | 40 | 5 | 35 | 10 | GCAaatgccagtagGT | 5642 | 234 |
| 234_1 | 81 | 6 | 72 | 25 | CTAatggaaggattTG | 5673 | 235 |
| 235_1 | 97 | 17 | 87 | 25 | AAtatagaacctaaTG | 5683 | 236 |
| 236_1 | 98 | 4 | 83 | 21 | GAAagaatagaatGTT | 5769 | 237 |
| 237_1 | 93 | 2 | 102 | 26 | ATGggtaatagattAT | 5893 | 238 |
| 238_1 | 110 | 24 | 44 | 14 | GAaagagcacagggTG | 6103 | 239 |
| 239_1 | 66 | 5 | 36 | 10 | CTACatagagggaaTG | 6202 | 240 |
| 240_1 | 70 | 4 | 34 | 8 | GCttcctacataGAGG | 6207 | 241 |
| 241_1 | 64 | NA | 33 | 6 | TGCTtcctacatagAG | 6208 | 242 |
| 242_1 | 30 | NA | 19 | 7 | TGggcttgaaataTGT | 6417 | 243 |
| 243_1 | 88 | 6 | 69 | 15 | CATtatatttaagaAC | 6457 | 244 |
| 244_1 | 8 | 2 | 5 | 2 | TCggttatgttaTCAT | 6470 | 245 |
| 245_1 | 18 | 9 | 12 | 4 | CActttatctggTCGG | 6482 | 246 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
|---|---|---|---|---|---|---|---|
| | % mRNA of control | sd | % mRNA of control | sd | | | |
| 246_1 | 37 | 2 | 19 | 5 | AAAttggcacagcGTT | 6505 | 247 |
| 247_1 | 46 | 12 | 29 | 8 | ACCGtgacagtaaATG | 6577 | 248 |
| 248_1 | 31 | 2 | 25 | 2 | TGggaaccgtgacagTA | 6581 | 249 |
| 249_1 | 17 | 2 | 23 | 9 | CCacatataggtcCTT | 6597 | 250 |
| 250_1 | 15 | 6 | 23 | 7 | CAtattgctaccaTAC | 6617 | 251 |
| 251_1 | 4 | 2 | 9 | 2 | TCAtattgctaccATA | 6618 | 252 |
| 252_1 | 65 | 12 | 85 | 14 | CAATtgtcatatTGCT | 6624 | 253 |
| 253_1 | 20 | 2 | 51 | 7 | CATtcaattgtcataTTG | 6626 | 254 |
| 254_1 | 48 | 8 | 91 | 41 | TTTCtactgggaaTTTG | 6644 | 255 |
| 255_1 | 11 | 5 | 23 | 8 | CAAttagtgcagcCAG | 6672 | 256 |
| 256_1 | 43 | 7 | 62 | 13 | GAATaatgttcttaTCC | 6704 | 257 |
| 257_1 | 28 | 2 | 36 | 19 | CACAaattgataatgtTCT | 6709 | 258 |
| 258_1 | 64 | 4 | 78 | 22 | CATGcacaaattgaaTAAT | 6714 | 259 |
| 259_1 | 53 | 8 | 104 | 73 | ATCctgcaatttcaCAT | 6832 | 260 |
| 260_1 | 54 | 5 | 59 | 14 | CCaccatagctgatCA | 6868 | 261 |
| 261_1 | 42 | 8 | 52 | 22 | ACcaccatagctgaTCA | 6868 | 262 |
| 262_1 | 68 | 5 | 118 | 66 | CAccaccatagctgaTC | 6869 | 263 |
| 263_1 | 40 | 2 | 73 | 20 | TAgtcggcaccaccAT | 6877 | 264 |
| 264_1 | 64 | 6 | 72 | 35 | CttgtagtcggcaccAC | 6880 | 265 |
| 265_1 | 56 | 4 | 82 | 35 | CttgtagtcggcacCA | 6881 | 266 |
| 266_1 | 41 | 5 | 46 | 21 | CGcttgtagtcggcAC | 6883 | 267 |
| 267_1 | 51 | 4 | 33 | 14 | TCAataaagatcagGC | 6942 | 268 |
| 268_1 | 61 | 2 | 49 | 10 | TGgacttacaagaaTG | 6986 | 269 |
| 269_1 | 45 | 7 | 40 | 9 | ATGgacttacaagaAT | 6987 | 270 |
| 270_1 | 51 | 12 | 36 | 12 | GCTCaagaaattggAT | 7073 | 271 |
| 271_1 | 17 | 0 | 14 | 5 | TACTgtagaacatgGC | 7133 | 272 |
| 272_1 | 15 | 3 | 11 | 3 | GCAAttcatttgaTCT | 7239 | 273 |
| 273_1 | 64 | 11 | ND | ND | TGaagggaggagggacAC | 7259 | 274 |
| 274_1 | 52 | 6 | 50 | 28 | AGtggtgaagggaggAG | 7265 | 275 |
| 275_1 | 79 | 7 | ND | ND | TAgtggtgaagggaggAG | 7265 | 276 |
| 276_1 | 81 | 6 | ND | ND | Atagtggtgaagggagg AG | 7265 | 277 |
| 277_1 | 70 | 9 | ND | ND | TAgtggtgaagggagGA | 7266 | 278 |
| 278_1 | 84 | 9 | ND | ND | ATagtggtgaagggagGA | 7266 | 279 |
| 279_1 | 40 | 6 | 64 | 53 | TAGtggtgaagggaGG | 7267 | 280 |
| 280_1 | 42 | 10 | ND | ND | ATAgtggtgaagggaGG | 7267 | 281 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
| --- | --- | --- | --- | --- | --- | --- | --- |
| | % mRNA of control | sd | % mRNA of control | sd | | | |
| 281_1 | 63 | 7 | ND | ND | GAtagtggtgaagggaGG | 7267 | 282 |
| 282_1 | 27 | 7 | 38 | 11 | ATAGtggtgaagggAG | 7268 | 283 |
| 283_1 | 60 | 22 | ND | ND | GAtagtggtgaaggGAG | 7268 | 284 |
| 284_1 | 23 | 3 | 97 | 54 | GAgatagtggtgAAGG | 7271 | 285 |
| 285_1 | 51 | 6 | 72 | 19 | CATGggagatagtgGT | 7276 | 286 |
| 286_1 | 7 | 1 | 21 | 9 | ACAAataatggttaCTCT | 7302 | 287 |
| 287_1 | 66 | 8 | 48 | 20 | ACACacaaataatgGTTA | 7306 | 288 |
| 288_1 | 67 | 6 | 58 | 20 | GAGggacacacaaaTAAT | 7311 | 289 |
| 289_1 | 46 | 2 | 50 | 21 | ATATagagaggcTCAA | 7390 | 290 |
| 290_1 | 22 | 6 | ND | ND | TTgatatagagaGGCT | 7393 | 291 |
| 291_1 | 11 | 2 | 17 | 3 | GCATttgatatagAGA | 7397 | 292 |
| 292_1 | 70 | 18 | 44 | 8 | TTtgcatttgataTAG | 7400 | 293 |
| 293_1 | 30 | 1 | 30 | 9 | CTGgaagaataggtTC | 7512 | 294 |
| 294_1 | 53 | 5 | 42 | 10 | ACTGgaagaataggTT | 7513 | 295 |
| 295_1 | 56 | 2 | 41 | 15 | TACTggaagaatagGT | 7514 | 296 |
| 296_1 | 80 | 8 | 53 | 13 | TGGCttatcctgtaCT | 7526 | 297 |
| 297_1 | 73 | 6 | 52 | 14 | ATggcttatcctGTAC | 7527 | 298 |
| 298_1 | 75 | 7 | 89 | 25 | TATGgcttatcctgTA | 7528 | 299 |
| 299_1 | 52 | 5 | 50 | 11 | GTAtggcttatccTGT | 7529 | 300 |
| 300_1 | 27 | 3 | 31 | 6 | ATgaatatatgccCAGT | 7547 | 301 |
| 301_1 | 41 | 8 | 33 | 9 | GAtgaatatatgCCCA | 7549 | 302 |
| 302_1 | 8 | 2 | ND | ND | CAAgatgaatatataTGCC | 7551 | 303 |
| 303_1 | 32 | 5 | 37 | 14 | GACAacatcagtaTAGA | 7572 | 304 |
| 304_1 | 28 | 5 | 30 | 23 | CAAGacaacatcAGTA | 7576 | 305 |
| 305_1 | 47 | 5 | 41 | 9 | CACtcctagttccTTT | 7601 | 306 |
| 306_1 | 39 | 6 | 33 | 7 | AACactcctagttCCT | 7603 | 307 |
| 307_1 | 68 | 3 | 42 | 14 | TAacactcctagtTCC | 7604 | 308 |
| 308_1 | 115 | 5 | 69 | 22 | CTaacactcctagtTC | 7605 | 309 |
| 309_1 | 97 | 16 | 57 | 14 | TGataacataactgTG | 7637 | 310 |
| 310_1 | 36 | 1 | 23 | 10 | CTgataacataaCTGT | 7638 | 311 |
| 311_1 | 38 | 5 | 24 | 5 | TTTGaactcaagtgAC | 7654 | 312 |
| 312_1 | 42 | 3 | 39 | 5 | TCCTttacttagcTAG | 7684 | 313 |
| 313_1 | 15 | 2 | 14 | 3 | GAgtttggattagCTG | 7764 | 314 |
| 314_1 | 49 | 28 | ND | ND | TGggatatgacagGGA | 7838 | 315 |
| 315_1 | 34 | 6 | ND | ND | TGTGggatatgacaGG | 7840 | 316 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
|---|---|---|---|---|---|---|---|
| | % mRNA of control | sd | % mRNA of control | sd | | | |
| 316_1 | 47 | 3 | 37 | 8 | ATATggaagggataTC | 7875 | 317 |
| 317_1 | 11 | 3 | ND | ND | ACAggatatggaaGGG | 7880 | 318 |
| 318_1 | 48 | 4 | ND | ND | ATTTcaacaggatATGG | 7885 | 319 |
| 319_1 | 18 | 2 | 16 | 4 | GAgtaatttcaacAGG | 7891 | 320 |
| 320_1 | 74 | 6 | 44 | 5 | AGGGagtaatttcAACA | 7893 | 321 |
| 321_1 | 38 | 5 | 56 | 28 | ATTAgggagtaatTTCA | 7896 | 322 |
| 322_1 | 66 | 9 | 32 | 11 | CTtactattaggGAGT | 7903 | 323 |
| 323_1 | 13 | 1 | 15 | 5 | CAgcttactattaGGG | 7906 | 324 |
| 324_1 | 26 | 4 | 20 | 9 | TCAgcttactattAGG | 7907 | 325 |
| 325_1 | 43 | 4 | 17 | 2 | ATTtcagcttactaTTAG | 7908 | 326 |
| 326_1 | 54 | 5 | 57 | 16 | TTcagcttactaTTAG | 7908 | 327 |
| 327_1 | 28 | 3 | 8 | 2 | CAGAtttcagcttaCT | 7913 | 328 |
| 328_1 | 43 | 4 | 37 | 16 | GACtacaactagagGG | 7930 | 329 |
| 329_1 | 45 | 12 | 36 | 10 | AGACtacaactagaGG | 7931 | 330 |
| 330_1 | 99 | 8 | 94 | 32 | AAgactacaactagAG | 7932 | 331 |
| 331_1 | 59 | 4 | 52 | 19 | ATGAtttaattctagtCAAA | 7982 | 332 |
| 332_1 | 100 | 2 | 84 | 23 | TTTaattctagtcAAA | 7982 | 333 |
| 333_1 | 91 | 9 | 60 | 19 | GATTtaattctaGTCA | 7984 | 334 |
| 771_1 | 74 | 6 | 50 | 5 | TGAtttaattctaGTCA | 7984 | 771 |
| 334_1 | 73 | 5 | 54 | 12 | ATGAtttaattctagTCA | 7984 | 335 |
| 335_1 | 15 | 1 | 26 | 3 | GATGatttaattctagtCA | 7984 | 336 |
| 336_1 | 71 | 22 | 49 | 16 | GAtttaattctaGTCA | 7984 | 337 |
| 337_1 | 43 | 5 | 30 | 11 | GATGatttaattctaGTC | 7985 | 338 |
| 338_1 | 98 | 5 | 90 | 27 | TGatttaattctagTC | 7985 | 339 |
| 339_1 | 87 | 21 | 86 | 2 | GAGAtgatttaatTCTA | 7988 | 340 |
| 340_1 | 92 | 5 | 85 | 27 | GAGatgatttaatTCT | 7989 | 341 |
| 341_1 | 7 | 1 | 7 | 1 | CAGAttgatggtagTT | 8030 | 342 |
| 342_1 | 7 | 2 | 24 | 11 | CTcagattgatgGTAG | 8032 | 343 |
| 343_1 | 3 | 1 | 14 | 9 | GTTagccctcagaTTG | 8039 | 344 |
| 344_1 | 14 | 5 | 20 | 7 | TGtattgttagcCCTC | 8045 | 345 |
| 345_1 | 10 | 2 | 11 | 5 | ACttgtattgttAGCC | 8048 | 346 |
| 346_1 | 52 | 4 | 52 | 17 | AGCcagtatcagggAC | 8191 | 347 |
| 347_1 | 33 | 3 | 18 | 8 | TTgacaatagtgGCAT | 8213 | 348 |
| 348_1 | 7 | 2 | 13 | 5 | ACAagtggtatctTCT | 8228 | 349 |
| 349_1 | 63 | 8 | 44 | 15 | AATCtactttacaaGT | 8238 | 350 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
| --- | --- | --- | --- | --- | --- | --- | --- |
| | % mRNA of control | sd | % mRNA of control | sd | | | |
| 350_1 | 36 | 2 | ND | ND | CAcagtagatgcctGATA | 8351 | 351 |
| 351_1 | 24 | 2 | 30 | 9 | GAacacagtagatGCC | 8356 | 352 |
| 352_1 | 23 | 4 | 103 | 14 | CTTGgaacacagtagAT | 8359 | 353 |
| 353_1 | 20 | 2 | 45 | 2 | ATAtcttggaacaCAG | 8364 | 354 |
| 354_1 | 25 | 3 | 24 | 6 | TCTttaatatcttgGAAC | 8368 | 355 |
| 355_1 | 39 | 2 | 41 | 10 | TGatttctttaatatCTTG | 8372 | 356 |
| 356_1 | 54 | 5 | 88 | 43 | TGatgatttctttaaTATC | 8375 | 357 |
| 357_1 | 31 | 4 | 45 | 27 | AGGctaagtcatgaTG | 8389 | 358 |
| 358_1 | 18 | 3 | 43 | 20 | TTGAtgaggctaagTC | 8395 | 359 |
| 359_1 | 6 | 2 | 11 | 2 | CCAggattatactcTT | 8439 | 360 |
| 360_1 | 43 | 5 | 40 | 14 | GCcaggattataCTCT | 8440 | 361 |
| 361_1 | 56 | 8 | 73 | 13 | CTGccaggattataCT | 8442 | 362 |
| 362_1 | 23 | 1 | 33 | 7 | CAGAaacttatactttaTG | 8473 | 363 |
| 363_1 | 49 | 8 | 45 | 14 | AAGCagaaacttaTACT | 8478 | 364 |
| 364_1 | 39 | 6 | 37 | 4 | GAAgcagaaacttaTACT | 8478 | 365 |
| 365_1 | 26 | 4 | 45 | 13 | TGGaagcagaaacttataCT | 8478 | 366 |
| 366_1 | 21 | 4 | 44 | 5 | TGGaagcagaaacttaTAC | 8479 | 367 |
| 367_1 | 97 | 4 | 70 | 22 | AAgcagaaacttaTAC | 8479 | 368 |
| 368_1 | 34 | 3 | 32 | 11 | TGGaagcagaaactTATA | 8480 | 369 |
| 369_1 | 71 | 7 | 46 | 19 | AAGGgatattatggAG | 8587 | 370 |
| 370_1 | Si | 9 | 79 | 38 | TGccggaagatttcCT | 8641 | 371 |
| 371_1 | 45 | 6 | 52 | 25 | ATGGattgggagtaGA | 8772 | 372 |
| 372_1 | 27 | 7 | 30 | 8 | AGatggattgggagTA | 8774 | 373 |
| 373_1 | 13 | 3 | 28 | 6 | AAGatggattgggaGT | 8775 | 374 |
| 374_1 | 42 | 10 | 44 | 11 | ACaagatggattGGGA | 8777 | 375 |
| 374_2 | 41 | 3 | 45 | 14 | ACaagatggattggGA | 8777 | 375 |
| 375_1 | 83 | 9 | 88 | 32 | AGAaggttcagaCTTT | 8835 | 376 |
| 376_1 | 40 | 5 | 33 | 3 | GCAgaaggttcagaCT | 8837 | 377 |
| 376_2 | 28 | 5 | 20 | 4 | GCagaaggttcagACT | 8837 | 377 |
| 377_1 | 70 | 2 | 43 | 8 | TGCAgaaggttcagAC | 8838 | 378 |
| 378_1 | 23 | 3 | 55 | 17 | AGtgcagaaggttCAG | 8840 | 379 |
| 378_2 | Si | 6 | 41 | 8 | AGTGcagaaggttcAG | 8840 | 379 |
| 379_1 | 34 | 6 | 35 | 7 | AAGTgcagaaggttCA | 8841 | 380 |
| 380_1 | 44 | 11 | 24 | 6 | TAagtgcagaagGTTC | 8842 | 381 |
| 381_1 | 37 | 5 | 45 | 9 | TCtaagtgcagaAGGT | 8844 | 382 |

TABLE 10-continued in vitro efficacy of anti-PD-L1 compounds in THP1 and KARPAS-299 cell lines (Average
from n = 3 experiments). PD-L1 mRNA levels are normalized to TBP in KARPAS-299 cells
or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
|---|---|---|---|---|---|---|---|
| | % mRNA of control | sd | % mRNA of control | sd | | | |
| 382_1 | 75 | 5 | 147 | 26 | CTCaggagttctactTC | 8948 | 383 |
| 383_1 | 90 | 10 | 141 | 55 | CTCaggagttctaCTT | 8949 | 384 |
| 384_1 | 73 | 8 | 234 | 116 | AtggaggtgactcaggAG | 8957 | 385 |
| 385_1 | 33 | 4 | 42 | 7 | ATggaggtgactcagGA | 8958 | 386 |
| 386_1 | 24 | 3 | 29 | 14 | ATggaggtgactcAGG | 8959 | 387 |
| 387_1 | 37 | 2 | 65 | 15 | TAtggaggtgactcAGG | 8959 | 388 |
| 388_1 | 50 | 10 | 81 | 19 | ATatggaggtgactcaGG | 8959 | 389 |
| 389_1 | 42 | 5 | 61 | 10 | TATGgaggtgactcAG | 8960 | 390 |
| 390_1 | 36 | 2 | 76 | 50 | ATatggaggtgacTCAG | 8960 | 391 |
| 391_1 | 52 | 6 | 64 | 6 | CAtatggaggtgactcAG | 8960 | 392 |
| 392_1 | 63 | 5 | 57 | 6 | ATAtggaggtgacTCA | 8961 | 393 |
| 393_1 | 53 | 7 | 64 | 12 | CAtatggaggtgacTCA | 8961 | 394 |
| 394_1 | Si | 5 | 56 | 24 | CAtatggaggtgACTC | 8962 | 395 |
| 395_1 | 23 | 3 | 41 | 34 | GCatatggaggtgacTC | 8962 | 396 |
| 396_1 | 34 | 3 | 54 | 10 | TGcatatggaggtgacTC | 8962 | 397 |
| 397_1 | 54 | 5 | 71 | 24 | TtgcatatggaggtgacTC | 8962 | 398 |
| 398_1 | 61 | 11 | 59 | 13 | TttgcatatggaggtgacTC | 8962 | 399 |
| 399_1 | 25 | 2 | 30 | 6 | GCatatggaggtgaCT | 8963 | 400 |
| 400_1 | 34 | 4 | 25 | 9 | TGcatatggaggtgaCT | 8963 | 401 |
| 401_1 | 25 | 4 | 31 | 20 | TTGcatatggaggtgaCT | 8963 | 402 |
| 402_1 | Si | 6 | 37 | 11 | TttgcatatggaggtgaCT | 8963 | 403 |
| 403_1 | 26 | 1 | 33 | 5 | TGCatatggaggtgAC | 8964 | 404 |
| 404_1 | 25 | 2 | 69 | 19 | TTGcatatggaggtGAC | 8964 | 405 |
| 405_1 | 26 | 4 | 24 | 4 | TTTGcatatggaggtgAC | 8964 | 406 |
| 406_1 | 19 | 3 | 20 | 7 | TTTGcatatggaggtGA | 8965 | 407 |
| 407_1 | 16 | 5 | 46 | 16 | TTtgcatatggaGGTG | 8966 | 408 |
| 408_1 | 9 | 2 | 9 | 6 | AAgtgaagttcaaCAGC | 8997 | 409 |
| 409_1 | 26 | 8 | 109 | 52 | TGggaagtgaagTTCA | 9002 | 410 |
| 410_1 | 31 | 5 | 24 | 5 | ATgggaagtgaagTTC | 9003 | 411 |
| 411_1 | 49 | 9 | 19 | 10 | GATGggaagtgaaGTT | 9004 | 412 |
| 412_1 | 28 | 10 | 17 | 9 | CTGtgatgggaagtGAA | 9007 | 413 |
| 413_1 | 54 | 4 | 34 | 8 | ATTgagtgaatccAAA | 9119 | 414 |
| 414_1 | 11 | 1 | 14 | 2 | AAttgagtgaatCCAA | 9120 | 415 |
| 415_1 | 58 | 6 | 14 | 2 | GATAattgagtgaaTCC | 9122 | 416 |
| 416_1 | 5 | 1 | 16 | 3 | GTGataattgagtGAA | 9125 | 417 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
|---|---|---|---|---|---|---|---|
| | % mRNA of control | sd | % mRNA of control | sd | | | |
| 417_1 | 73 | 5 | 61 | 14 | AAGaaaggtgcaaTAA | 9155 | 418 |
| 418_1 | 86 | 6 | 64 | 13 | CAagaaaggtgcAATA | 9156 | 419 |
| 419_1 | 75 | 19 | 64 | 14 | ACAAgaaaggtgcaAT | 9157 | 420 |
| 420_1 | 75 | 8 | 50 | 13 | ATttaaactcacaaAC | 9171 | 421 |
| 421_1 | 21 | 8 | 23 | 6 | CTgttaggttcaGCGA | 9235 | 422 |
| 422_1 | 54 | 10 | 30 | 5 | TCTGaatgaacatTTCG | 9260 | 423 |
| 423_1 | 11 | 4 | 15 | 5 | CTcattgaaggtTCTG | 9281 | 424 |
| 424_1 | 87 | 3 | 52 | 8 | CTAatctcattgaaGG | 9286 | 425 |
| 425_1 | 95 | 1 | 85 | 13 | CCtaatctcattgaAG | 9287 | 426 |
| 426_1 | 31 | 7 | 22 | 7 | ACTttgatctttcAGC | 9305 | 427 |
| 427_1 | 64 | 7 | 49 | 16 | ACtatgcaacacttTG | 9315 | 428 |
| 428_1 | 18 | 6 | 21 | 3 | CAAatagctttatCGG | 9335 | 429 |
| 429_1 | 19 | 6 | 17 | 4 | CCaaatagcttttATCG | 9336 | 430 |
| 430_1 | 35 | 4 | 27 | 8 | TCCAaatagcttttaTC | 9337 | 431 |
| 431_1 | 75 | 8 | 43 | 7 | GATCcaaatagcttTA | 9339 | 432 |
| 432_1 | 67 | 11 | 32 | 8 | ATgatccaaataGCTT | 9341 | 433 |
| 433_1 | 53 | 5 | 43 | 6 | TATGatccaaatagCT | 9342 | 434 |
| 434_1 | 97 | 9 | 66 | 29 | TAAAcagggctggGAAT | 9408 | 435 |
| 435_1 | 58 | 12 | 44 | 17 | ACttaaacagggCTGG | 9412 | 436 |
| 436_1 | 58 | 10 | 30 | 12 | ACacttaaacagGGCT | 9414 | 437 |
| 437_1 | 87 | 38 | 41 | 3 | GAACacttaaacAGGG | 9416 | 438 |
| 438_1 | 70 | 4 | 59 | 33 | AGAGaacacttaaACAG | 9418 | 439 |
| 439_1 | 83 | 17 | 28 | 9 | CTACagagaacaCTTA | 9423 | 440 |
| 440_1 | 49 | 12 | 27 | 4 | ATGctacagagaaCACT | 9425 | 441 |
| 441_1 | 53 | 10 | 24 | 13 | ATAAatgctacagagAACA | 9427 | 442 |
| 442_1 | 23 | 6 | 20 | 10 | AGataaatgctacaGAGA | 9430 | 443 |
| 443_1 | 48 | 6 | 27 | 7 | TAGAgataaatgcTACA | 9434 | 444 |
| 444_1 | 51 | 3 | 32 | 8 | TAGAtagagataaatGCT | 9437 | 445 |
| 445_1 | 38 | 5 | ND | ND | CAATatactagataGAGA | 9445 | 446 |
| 446_1 | 52 | 3 | 31 | 1 | TACAcaatatactagATAG | 9448 | 447 |
| 447_1 | 65 | 6 | 48 | 11 | CTAcacaatatacTAG | 9452 | 448 |
| 448_1 | 67 | 9 | 29 | 2 | GCTAcacaatatACTA | 9453 | 449 |
| 449_1 | 103 | 17 | 65 | 15 | ATATgctacacaatATAC | 9455 | 450 |
| 450_1 | 71 | 13 | 129 | 22 | TGATatgctacaCAAT | 9459 | 451 |
| 451_1 | 19 | 4 | 9 | 1 | ATGAtatgatatgCTAC | 9464 | 452 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
|---|---|---|---|---|---|---|---|
| | % mRNA of control | sd | % mRNA of control | sd | | | |
| 452_1 | 75 | 10 | 45 | 21 | GAGGagagagacaaTAAA | 9495 | 453 |
| 453_1 | 68 | 6 | 43 | 10 | CTAggaggagagagACA | 9500 | 454 |
| 454_1 | 72 | 7 | 79 | 25 | TATTctaggaggagAGA | 9504 | 455 |
| 455_1 | 31 | 3 | 29 | 9 | TTATattctaggagGAG | 9507 | 456 |
| 456_1 | 38 | 5 | 62 | 17 | GTTtatattctaGGAG | 9510 | 457 |
| 457_1 | 15 | 6 | 15 | 8 | TGgagtttatattcTAGG | 9512 | 458 |
| 458_1 | 34 | 3 | 21 | 3 | CGtaccaccactcTGC | 9590 | 459 |
| 459_1 | 41 | 5 | 55 | 22 | TGAGgaaatcattcATTC | 9641 | 460 |
| 460_1 | 81 | 8 | 47 | 22 | TTTGaggaaatcatTCAT | 9643 | 461 |
| 461_1 | 76 | 8 | 39 | 5 | AGGCtaatcctattTG | 9657 | 462 |
| 462_1 | 93 | 12 | 216 | 12 | TTTAggctaatcCTAT | 9660 | 463 |
| 463_1 | 15 | 6 | 30 | 9 | TGCtccagtgtaccCT | 9755 | 464 |
| 464_1 | 27 | 3 | 25 | 6 | TAgtagtactcgATAG | 9813 | 465 |
| 465_1 | 9 | 2 | 7 | 3 | CTAattgtagtagtaCTC | 9818 | 466 |
| 466_1 | 52 | 3 | 32 | 6 | TGctaattgtagTAGT | 9822 | 467 |
| 467_1 | 68 | 11 | 36 | 16 | AGTGctaattgtagTA | 9824 | 468 |
| 468_1 | 35 | 6 | 32 | 3 | GCAagtgctaattgTA | 9827 | 469 |
| 469_1 | 91 | 9 | ND | ND | GAGGaaatgaactaattTA | 9881 | 470 |
| 470_1 | 92 | 5 | ND | ND | CAGGaggaaatgaacTA | 9886 | 471 |
| 471_1 | 67 | 5 | 42 | 6 | CCctagagtcattTCC | 9902 | 472 |
| 472_1 | 35 | 5 | 20 | 8 | ATCttacatgatgaAGC | 9925 | 473 |
| 473_1 | 13 | 1 | 20 | 5 | GACacactcagatttcAG | 9967 | 474 |
| 474_1 | 24 | 4 | 20 | 2 | AGacacactcagatttcAG | 9967 | 475 |
| 475_1 | 25 | 4 | 24 | 7 | AAGacacactcagatttcAG | 9967 | 476 |
| 476_1 | 26 | 6 | 19 | 4 | AGacacactcagattTCA | 9968 | 477 |
| 477_1 | 28 | 4 | 32 | 13 | AAGacacactcagattTCA | 9968 | 478 |
| 478_1 | 31 | 8 | 37 | 6 | AAagacacactcagatTTCA | 9968 | 479 |
| 479_1 | 63 | 7 | 51 | 26 | GAAagacacactcagatTTC | 9969 | 480 |
| 480_1 | 37 | 10 | ND | ND | AAGAcacactcagatTTC | 9969 | 481 |
| 481_1 | 41 | 4 | ND | ND | AAAGacacactcagaTTTC | 9969 | 482 |
| 482_1 | 19 | 5 | 48 | 14 | TGAAagacacactcagatTT | 9970 | 483 |
| 483_1 | 60 | 8 | 68 | 10 | TGaaagacacactcaGATT | 9971 | 484 |
| 484_1 | 42 | 8 | 63 | 22 | TGAaagacacactcaGAT | 9972 | 485 |
| 485_1 | 48 | 9 | 41 | 20 | ATTgaaagacacacTCA | 9975 | 486 |
| 486_1 | 27 | 6 | 27 | 12 | TCattgaaagacaCACT | 9977 | 487 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 μM CMP | | THP1 cells 20 μM CMP | | Compound (CMP) | Start on SEQ ID NO 1 | SEQ ID NO |
|---|---|---|---|---|---|---|---|
| | % mRNA of control | sd | % mRNA of control | sd | | | |
| 487_1 | 88 | 13 | 121 | 33 | TTCcatcattgaAAGA | 9983 | 488 |
| 488_1 | 80 | 12 | ND | ND | ATAAtaccacttaTCAT | 10010 | 489 |
| 489_1 | 13 | 4 | 27 | 15 | TTacttaatttcttTGGA | 10055 | 490 |
| 490_1 | 32 | 5 | 60 | 24 | TTAgaactagctttaTCA | 10101 | 491 |
| 491_1 | 58 | 10 | 55 | 17 | GAGgtacaaatatAGG | 10171 | 492 |
| 492_1 | 4 | 1 | 12 | 3 | CTTatgatacaacTTA | 10384 | 493 |
| 493_1 | 37 | 6 | 35 | 5 | TCttatgatacaaCTT | 10385 | 494 |
| 494_1 | 30 | 0 | 27 | 6 | TTCttatgatacaaCT | 10386 | 495 |
| 495_1 | 27 | 8 | 18 | 3 | CAgtttcttatgaTAC | 10390 | 496 |
| 496_1 | 25 | 10 | 25 | 6 | GCAgtttcttatgaTA | 10391 | 497 |
| 497_1 | 77 | 6 | 72 | 29 | TACAaatgtctattagGTT | 10457 | 498 |
| 498_1 | 66 | 5 | 69 | 17 | TGTAcaaatgtctatTAG | 10460 | 499 |
| 499_1 | 27 | 10 | 20 | 4 | AGCatcacaattagTA | 10535 | 500 |
| 500_1 | 31 | 10 | 25 | 5 | CTAatgatagtgaaGC | 10548 | 501 |
| 501_1 | 21 | 7 | 30 | 8 | AGCtaatgatagtgAA | 10550 | 502 |
| 502_1 | 35 | 5 | 39 | 8 | ATGCcttgacatatTA | 10565 | 503 |
| 503_1 | 64 | 11 | 79 | 26 | CTCAagattattgACAC | 10623 | 504 |
| 504_2 | 25 | 4 | 83 | 32 | ACctcaagattaTTGA | 10626 | 505 |
| 504_1 | 94 | 7 | 22 | 6 | ACCtcaagattaTTGA | 10626 | 505 |
| 505_1 | 31 | 6 | 34 | 10 | AACCtcaagattatTG | 10627 | 506 |
| 506_1 | 55 | 6 | 62 | 17 | CACAaacctcaagattaTT | 10628 | 507 |
| 507_1 | 66 | 12 | 40 | 4 | GTActtaattagACCT | 10667 | 508 |
| 508_1 | 78 | 5 | 80 | 10 | AGTActtaattagACC | 10668 | 509 |
| 509_1 | 36 | 5 | 42 | 15 | GTATgaggtggtaaAC | 10688 | 510 |
| 510_1 | 40 | 4 | 48 | 22 | AGgaaacagcagaAGTG | 10723 | 511 |
| 511_1 | 27 | 7 | 13 | 6 | GCacaacccagaggAA | 10735 | 512 |
| 512_1 | 54 | 5 | ND | ND | CAAgcacaacccagAG | 10738 | 513 |
| 513_1 | 35 | 7 | ND | ND | TTCaagcacaaccCAG | 10740 | 514 |
| 514_1 | 49 | 6 | 52 | 15 | AAttcaagcacaACCC | 10742 | 515 |
| 515_1 | 72 | 4 | 106 | 49 | TAATaattcaagcacaaCC | 10743 | 516 |
| 516_1 | 43 | 4 | 57 | 21 | ACTAataattcaaGCAC | 10747 | 517 |
| 517_1 | 37 | 3 | 60 | 12 | ATAAtactaataattcAAGC | 10749 | 518 |
| 518_1 | 9 | 3 | 6 | 1 | TAgatttgtgagGTAA | 11055 | 519 |
| 519_1 | 59 | 10 | 31 | 5 | AGCCttaattctccAT | 11091 | 520 |
| 520_1 | 41 | 4 | 34 | 9 | AATGatctagagcCTTA | 11100 | 521 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
|---|---|---|---|---|---|---|---|
| | % mRNA of control | sd | % mRNA of control | sd | | | |
| 521_1 | 34 | 6 | 34 | 7 | CTAatgatctagaGCC | 11103 | 522 |
| 522_1 | 52 | 6 | 52 | 17 | ACTaatgatctaGAGC | 11104 | 523 |
| 523_1 | 60 | 4 | 54 | 10 | CATtaacatgttctTATT | 11165 | 524 |
| 524_1 | 57 | 4 | 55 | 8 | ACAAgtacattaacatGTTC | 11170 | 525 |
| 525_1 | 53 | 6 | 44 | 5 | TTACaagtacattaaCATG | 11173 | 526 |
| 526_1 | 54 | 11 | 49 | 17 | GCTTtattcatgtTTAT | 11195 | 527 |
| 527_1 | 34 | 7 | 17 | 5 | GCTttattcatgttTA | 11196 | 528 |
| 528_1 | 11 | 2 | 21 | 4 | AGAgctttattcatgtTT | 11197 | 529 |
| 529_1 | 22 | 4 | 33 | 7 | ATAAgagctttattCATG | 11200 | 530 |
| 530_1 | 30 | 5 | 32 | 15 | CATAagagctttaTTCA | 11202 | 531 |
| 531_1 | 77 | 8 | 24 | 4 | AGCAtaagagctTTAT | 11205 | 532 |
| 532_1 | 8 | 3 | 15 | 6 | TAGattgtttagtGCA | 11228 | 533 |
| 533_1 | 4 | 2 | 10 | 2 | GTagattgtttaGTGC | 11229 | 534 |
| 534_1 | 41 | 6 | 33 | 11 | GACAattctagtaGATT | 11238 | 535 |
| 535_1 | 50 | 1 | 37 | 7 | CTGacaattctaGTAG | 11241 | 536 |
| 536_1 | 49 | 7 | 36 | 6 | GCTGacaattctagTA | 11242 | 537 |
| 537_1 | 59 | 2 | 42 | 11 | AGgattaagatacgTA | 11262 | 538 |
| 538_1 | 28 | 11 | 28 | 4 | CAggattaagataCGT | 11263 | 539 |
| 539_1 | 96 | 5 | 20 | 6 | TCAggattaagataCG | 11264 | 540 |
| 540_1 | 70 | 11 | 59 | 11 | TTcaggattaagATAC | 11265 | 541 |
| 541_1 | 53 | 5 | 28 | 4 | AGGAagaaagtttgATTC | 11308 | 542 |
| 542_1 | 92 | 13 | 59 | 12 | TCAAggaagaaagtTTGA | 11311 | 543 |
| 543_1 | 44 | 3 | 67 | 7 | CTCAaggaagaaagTTTG | 11312 | 544 |
| 544_1 | 43 | 4 | 32 | 4 | TGCtcaaggaagaAAGT | 11315 | 545 |
| 545_1 | 41 | 7 | 44 | 20 | AATTatgctcaaggaAGA | 11319 | 546 |
| 546_1 | 11 | 4 | 26 | 8 | TAGGataccacattatGA | 11389 | 547 |
| 547_1 | 25 | 4 | 26 | 12 | CAtaatttattccattcCTC | 11449 | 548 |
| 548_1 | 64 | 6 | ND | ND | TGCAtaatttattcCAT | 11454 | 549 |
| 549_1 | 48 | 17 | 49 | 7 | ACTGcataatttatTCC | 11456 | 550 |
| 550_1 | 91 | 10 | 92 | 15 | CTAAactgcataattTATT | 11458 | 551 |
| 551_1 | 85 | 8 | 38 | 9 | ATaactaaactgCATA | 11465 | 552 |
| 552_1 | 86 | 4 | ND | ND | TTAttaataactaaaCTGC | 11468 | 553 |
| 553_1 | 91 | 13 | 92 | 21 | TAGTacattattaataaCT | 11475 | 554 |
| 554_1 | 50 | 4 | 37 | 7 | CATAactaaggacgTT | 11493 | 555 |
| 555_1 | 41 | 5 | 30 | 7 | TCataactaaggaCGT | 11494 | 556 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
| --- | --- | --- | --- | --- | --- | --- | --- |
| | % mRNA of control | sd | % mRNA of control | sd | | | |
| 556_1 | 80 | 7 | 55 | 13 | CGTCataactaaggAC | 11496 | 557 |
| 557_1 | 86 | 3 | 59 | 11 | TCgtcataactaagGA | 11497 | 558 |
| 558_1 | 81 | 9 | 33 | 12 | ATcgtcataactAAGG | 11498 | 559 |
| 559_1 | 91 | 6 | 65 | 26 | GTtagtatcttacATT | 11525 | 560 |
| 560_1 | 30 | 3 | 41 | 8 | CTCtattgttagtATC | 11532 | 561 |
| 561_1 | 59 | 8 | 18 | 6 | AGTatagagttacTGT | 11567 | 562 |
| 562_1 | 65 | 11 | 41 | 11 | TTCCtggtgatactTT | 11644 | 563 |
| 563_1 | 57 | 13 | 45 | 13 | GTTCctggtgatacTT | 11645 | 564 |
| 564_1 | 57 | 15 | 30 | 7 | TGttcctggtgataCT | 11646 | 565 |
| 565_1 | 17 | 4 | 35 | 4 | ATaaacatgaatctCTCC | 11801 | 566 |
| 566_1 | 16 | 3 | 30 | 4 | CTTtataaacatgaaTCTC | 11804 | 567 |
| 567_1 | 60 | 5 | 45 | 11 | CTGtctttataaaCATG | 11810 | 568 |
| 568_1 | 20 | 2 | 19 | 5 | TTgttataaatctgTCTT | 11820 | 569 |
| 569_1 | 68 | 9 | 44 | 4 | TTAaatttattcttgGATA | 11849 | 570 |
| 570_1 | 76 | 8 | 48 | 12 | CTtaaatttattctTGGA | 11851 | 571 |
| 571_1 | 62 | 5 | 66 | 5 | CTTCttaaatttattctTG | 11853 | 572 |
| 572_1 | 28 | 4 | 44 | 10 | TATGtttctcagtAAAG | 11877 | 573 |
| 573_1 | 29 | 6 | 36 | 11 | GAAttatctttaaACCA | 11947 | 574 |
| 574_1 | 74 | 6 | 34 | 7 | CCCttaaatttctaCA | 11980 | 575 |
| 575_1 | 37 | 8 | 30 | 9 | ACACtgctcttgtaCC | 11995 | 576 |
| 576_1 | 45 | 14 | 27 | 6 | TGAcaacactgctCTT | 12000 | 577 |
| 577_1 | 2 | 1 | 12 | 5 | TACAtttattgggcTC | 12081 | 578 |
| 578_1 | 65 | 14 | 39 | 9 | GTacatttattgGGCT | 12082 | 579 |
| 579_1 | 34 | 4 | 53 | 12 | TTGgtacatttatTGG | 12085 | 580 |
| 580_1 | 41 | 7 | 35 | 6 | CATGttggtacattTAT | 12088 | 581 |
| 581_1 | 11 | 4 | 12 | 5 | AATCatgttggtacAT | 12092 | 582 |
| 582_1 | 96 | 16 | 48 | 9 | AAatcatgttggtaCA | 12093 | 583 |
| 583_1 | 71 | 15 | 42 | 13 | GACaagtttggattAA | 12132 | 584 |
| 584_1 | 46 | 34 | 39 | 6 | AAtgttcagatgCCTC | 12197 | 585 |
| 585_1 | 37 | 26 | 28 | 12 | GCttaatgttcagaTG | 12201 | 586 |
| 586_1 | 75 | 8 | 43 | 12 | CGTAcatagcttgaTG | 12267 | 587 |
| 587_1 | 41 | 10 | 28 | 5 | GTGaggaattaggaTA | 12753 | 588 |
| 588_1 | 41 | 5 | 27 | 9 | GTAacaatatggttTG | 12780 | 589 |
| 589_1 | 67 | 10 | 37 | 7 | GAaatattgtagaCTA | 13151 | 590 |
| 590_1 | 97 | 10 | 80 | 12 | TTGaaatattgtagAC | 13153 | 591 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
|---|---|---|---|---|---|---|---|
| | % mRNA of control | sd | % mRNA of control | sd | | | |
| 591_1 | 64 | 10 | 47 | 9 | AAgtctagtaatTTGC | 13217 | 592 |
| 592_1 | 84 | 7 | 60 | 9 | GCTCagtagattatAA | 13259 | 593 |
| 593_1 | 42 | 8 | 32 | 9 | CATacactgttgcTAA | 13296 | 594 |
| 594_1 | 101 | 6 | 79 | 17 | ATGgtctcaaatcATT | 13314 | 595 |
| 595_1 | 53 | 14 | 46 | 7 | CAATggtctcaaatCA | 13316 | 596 |
| 596_1 | 47 | 6 | 36 | 6 | TTCCtattgattgaCT | 13568 | 597 |
| 597_1 | 97 | 12 | 41 | 6 | TTTCtgttcacaacAC | 13600 | 598 |
| 598_1 | 85 | 1 | 49 | 11 | AGgaacccactaaTCT | 13702 | 599 |
| 599_1 | 56 | 3 | 34 | 7 | TAAatggcaggaacCC | 13710 | 600 |
| 600_1 | 15 | 4 | 24 | 8 | GTAAatggcaggaaCC | 13711 | 601 |
| 601_1 | 40 | 6 | 26 | 8 | TTgtaaatggcagGAA | 13713 | 602 |
| 602_1 | 59 | 12 | 26 | 6 | TTatgagttaggCATG | 13835 | 603 |
| 603_1 | 62 | 2 | 42 | 10 | CCAggtgaaactttAA | 13935 | 604 |
| 604_1 | 77 | 9 | 55 | 18 | CCCttagtcagctCCT | 13997 | 605 |
| 605_1 | 82 | 13 | 42 | 11 | ACccttagtcagCTCC | 13998 | 606 |
| 606_1 | 74 | 1 | 39 | 10 | CAccttagtcagCTC | 13999 | 607 |
| 607_1 | 76 | 9 | 30 | 8 | TCTcttactaggcTCC | 14091 | 608 |
| 608_1 | 82 | 5 | 50 | 13 | CCtatctgtcatcATG | 14178 | 609 |
| 609_1 | 82 | 1 | 48 | 12 | TCCtatctgtcatcAT | 14179 | 610 |
| 610_1 | 41 | 6 | 50 | 13 | GAGaagtgtgagaaGC | 14808 | 611 |
| 611_1 | 70 | 5 | 84 | 19 | CATCcttgaagtttAG | 14908 | 612 |
| 612_1 | 64 | 14 | 61 | 16 | TAAtaagatggctCCC | 15046 | 613 |
| 613_1 | 85 | 2 | Si | 14 | CAAggcataataagAT | 15053 | 614 |
| 614_1 | 47 | 1 | 35 | 10 | CCaaggcataatAAGA | 15054 | 615 |
| 615_1 | 74 | 8 | 53 | 11 | TGatccaattctcaCC | 15151 | 616 |
| 616_1 | 63 | 4 | 41 | 11 | ATGatccaattctCAC | 15152 | 617 |
| 617_1 | 46 | 7 | 42 | 9 | CGCttcatcttcacCC | 15260 | 618 |
| 618_1 | 104 | 4 | 15 | 4 | TAtgacactgcaTCTT | 15317 | 619 |
| 619_1 | 8 | 3 | 8 | 5 | GTAtgacactgcaTCT | 15318 | 620 |
| 620_1 | 21 | 3 | 27 | 10 | TGtatgacactgCATC | 15319 | 621 |
| 621_1 | 37 | 7 | 38 | 11 | TTCTcttctgtaagTC | 15363 | 622 |
| 622_1 | 49 | 7 | 36 | 11 | TTctacagaggaACTA | 15467 | 623 |
| 623_1 | 47 | 1 | 32 | 10 | ACTacagttctacAGA | 15474 | 624 |
| 624_1 | 78 | 8 | 69 | 6 | TTCCcacaggtaaaTG | 15561 | 625 |
| 625_1 | 70 | 7 | ND | ND | ATTAtttgaatatactCATT | 15594 | 626 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
| --- | --- | --- | --- | --- | --- | --- | --- |
| | % mRNA of control | sd | % mRNA of control | sd | | | |
| 626_1 | 73 | 7 | 49 | 25 | TGGGaggaaattatTTG | 15606 | 627 |
| 627_1 | 80 | 5 | 64 | 11 | TGACtcatcttaaaTG | 15621 | 628 |
| 628_1 | 71 | 6 | 66 | 19 | CTGactcatcttaaAT | 15622 | 629 |
| 629_1 | 31 | 6 | 41 | 6 | TTTactctgactcATC | 15628 | 630 |
| 630_1 | 88 | 2 | 68 | 18 | TATtggaggaattaTT | 15642 | 631 |
| 631_1 | 53 | 2 | 27 | 6 | GTAttggaggaattAT | 15643 | 632 |
| 632_1 | 23 | 3 | 39 | 7 | TGgtatacttctctaagTAT | 15655 | 633 |
| 633_1 | 42 | 9 | 33 | 3 | GATCtcttggtataCT | 15666 | 634 |
| 634_1 | 38 | 1 | 30 | 16 | CAgacaactctataCC | 15689 | 635 |
| 635_1 | 10 | 2 | 19 | 3 | AACAtcagacaacTCTA | 15693 | 636 |
| 636_1 | 13 | 1 | 11 | 3 | TAACatcagacaacTC | 15695 | 637 |
| 637_1 | 14 | 2 | 27 | 2 | TTTAacatcagacaACTC | 15695 | 638 |
| 638_1 | 101 | 14 | 81 | 16 | ATttaacatcagacAA | 15698 | 639 |
| 639_1 | 14 | 1 | 17 | 1 | CCtatttaacatcAGAC | 15700 | 640 |
| 640_1 | 65 | 2 | ND | ND | TCCctatttaacaTCA | 15703 | 641 |
| 641_1 | 41 | 6 | 42 | 12 | TCAAcgactattgGAAT | 15737 | 642 |
| 642_1 | 37 | 2 | 29 | 5 | CTTAtattctggcTAT | 15850 | 643 |
| 643_1 | 31 | 7 | 35 | 4 | ATCCttatattctgGC | 15853 | 644 |
| 644_1 | 13 | 3 | 8 | 1 | GAtccttatattCTGG | 15854 | 645 |
| 645_1 | 25 | 5 | 20 | 4 | TGAtccttatattCTG | 15855 | 646 |
| 646_1 | 33 | 6 | 54 | 10 | ATTGaaacttgaTCCT | 15864 | 647 |
| 647_1 | 43 | 3 | 27 | 6 | ACtgtcattgaaACTT | 15870 | 648 |
| 648_1 | 54 | 7 | 32 | 12 | TCTtactgtcattgAA | 15874 | 649 |
| 649_1 | 12 | 1 | 25 | 2 | AGgatcttactgtCATT | 15877 | 650 |
| 650_1 | 13 | 4 | 11 | 3 | GCAaatcaactccATC | 15896 | 651 |
| 651_1 | 10 | 5 | 16 | 3 | GTGcaaatcaactCCA | 15898 | 652 |
| 652_1 | 7 | 0 | 36 | 18 | CAATtatttctttgTGC | 15910 | 653 |
| 653_1 | 21 | 3 | 31 | 7 | TGGcaacaattattTCTT | 15915 | 654 |
| 654_1 | 75 | 9 | 73 | 24 | GCTggcaacaatTATT | 15919 | 655 |
| 655_1 | 21 | 6 | 39 | 6 | ATCCatttctactgCC | 15973 | 656 |
| 656_1 | 25 | 3 | 38 | 8 | TAATatctattgattTCTA | 15988 | 657 |
| 657_1 | 14 | 2 | 11 | 5 | TCaatagtgtagggCA | 16093 | 658 |
| 658_1 | 11 | 4 | 10 | 3 | TTCaatagtgtaggGC | 16094 | 659 |
| 659_1 | 18 | 1 | 32 | 12 | AGGTtaattaattcaATAG | 16102 | 660 |
| 660_1 | 33 | 7 | 25 | 10 | CATttgtaatccCTAG | 16163 | 661 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
|---|---|---|---|---|---|---|---|
| | % mRNA of control | sd | % mRNA of control | sd | | | |
| 660_2 | 64 | 14 | 31 | 8 | CATttgtaatcccTAG | 16163 | 661 |
| 661_1 | 48 | 6 | 34 | 6 | ACAtttgtaatccCTA | 16164 | 662 |
| 662_2 | 29 | 6 | 23 | 5 | AAcatttgtaatCCCT | 16165 | 663 |
| 662_1 | 30 | 6 | 18 | 6 | AACatttgtaatCCCT | 16165 | 663 |
| 663_1 | 49 | 1 | 26 | 6 | TAaatttcaagttCTG | 16184 | 664 |
| 664_1 | 17 | 3 | 30 | 10 | GTTtaaatttcaagTTCT | 16185 | 665 |
| 665_1 | 22 | 7 | 40 | 9 | CCAgtttaaatttCAAG | 16189 | 666 |
| 666_1 | 89 | 11 | ND | ND | ACCCaagtttaaaTTTC | 16192 | 667 |
| 667_1 | 60 | 16 | 87 | 8 | CAtacagtgacccaagTTT | 16199 | 668 |
| 668_1 | 65 | 9 | 50 | 12 | ACatcccatacagTGA | 16208 | 669 |
| 669_1 | 83 | 8 | 103 | 4 | AGcacagctctaCATC | 16219 | 670 |
| 670_1 | 80 | 9 | 150 | 36 | ATAtagcacagcTCTA | 16223 | 671 |
| 671_1 | 57 | 14 | ND | ND | TCCatatagcacagCT | 16226 | 672 |
| 672_1 | 53 | 10 | 106 | 8 | ATTtccatatagCACA | 16229 | 673 |
| 673_1 | 78 | 3 | 96 | 14 | TTTAtttccatatAGCA | 16231 | 674 |
| 674_1 | 77 | 9 | 31 | 7 | TTTatttccatatAGC | 16232 | 675 |
| 675_1 | 32 | 6 | ND | ND | AAGGagaggagatTATG | 16409 | 676 |
| 676_1 | 32 | 5 | 24 | 6 | AGTtcttgtgttagCT | 16456 | 677 |
| 677_1 | 19 | 4 | 17 | 4 | GAgttcttgtgttaGC | 16457 | 678 |
| 678_1 | 14 | 3 | 25 | 3 | ATTaattatccatCCAC | 16590 | 679 |
| 679_1 | 11 | 2 | 20 | 6 | ATCaattaattatcCATC | 16593 | 680 |
| 680_1 | 31 | 5 | 40 | 11 | AGAatcaattaattaTCC | 16596 | 681 |
| 681_1 | 8 | 3 | 30 | 10 | TGagataccgtgcaTG | 16656 | 682 |
| 682_1 | 11 | 3 | ND | ND | AAtgagataccgTGCA | 16658 | 683 |
| 683_1 | 15 | 3 | 33 | 10 | CTGtggttaggctaAT | 16834 | 684 |
| 684_1 | 45 | 7 | 38 | 7 | Aagagtaagggtctgtggtt | 16842 | 685 |
| 685_1 | 24 | 5 | ND | ND | GATGggttaagagTAA | 16854 | 686 |
| 686_1 | 11 | 2 | ND | ND | AGCagatgggttaaGA | 16858 | 687 |
| 687_1 | ND | ND | 51 | 7 | TGtaaacatttgTAGC | 16886 | 688 |
| 688_1 | 83 | 1 | 54 | 11 | CCTgcttataaatgTA | 16898 | 689 |
| 689_1 | 103 | 4 | 73 | 14 | TGCCctgcttataaAT | 16901 | 690 |
| 690_1 | 104 | 2 | 64 | 22 | TCttcttagttcaaTA | 16935 | 691 |
| 691_1 | ND | ND | 60 | 9 | TGgttctctaactACAT | 16980 | 692 |
| 692_1 | ND | ND | 94 | 22 | AGtttggttctaaCTA | 16983 | 693 |
| 693_1 | 8 | 2 | 17 | 5 | GAAtgaaacttgcCTG | 17047 | 694 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
|---|---|---|---|---|---|---|---|
| | % mRNA of control | sd | % mRNA of control | sd | | | |
| 694_1 | 98 | 6 | 51 | 9 | ATTatccttacatGAT | 17173 | 695 |
| 695_1 | 48 | 4 | 18 | 4 | GTacccaattatcCTT | 17180 | 696 |
| 696_1 | 94 | 2 | 48 | 9 | TGTacccaattatCCT | 17181 | 697 |
| 697_1 | 31 | 5 | 42 | 13 | TTgtacccaattaTCC | 17182 | 698 |
| 698_1 | 41 | 4 | 39 | 6 | TTTgtacccaattaTC | 17183 | 699 |
| 699_1 | 63 | 0 | 28 | 12 | AGCAgcaggttataTT | 17197 | 700 |
| 700_1 | 99 | 6 | 43 | 12 | TGGgaagtggtctGGG | 17292 | 701 |
| 701_1 | 103 | 2 | 28 | 5 | CTGgagagtgataaTA | 17322 | 702 |
| 702_1 | 52 | 6 | 27 | 9 | AATGctggattacgTC | 17354 | 703 |
| 703_1 | 67 | 3 | 37 | 7 | CAatgctggattaCGT | 17355 | 704 |
| 704_1 | 36 | 10 | 80 | 12 | TTgttcagaagtATCC | 17625 | 705 |
| 705_1 | 19 | 9 | 47 | 9 | GAtgatttgcttGGAG | 17646 | 706 |
| 706_1 | 44 | NA | 60 | 9 | GAAatcattcacaACC | 17860 | 707 |
| 707_1 | 46 | 9 | 32 | 9 | TTGtaacatctacTAC | 17891 | 708 |
| 708_1 | 56 | 0 | 79 | 17 | CATtaagcagcaagTT | 17923 | 709 |
| 709_1 | 30 | 9 | 46 | 7 | TTActagatgtgagCA | 17942 | 710 |
| 710_1 | 29 | 4 | 36 | 6 | TTtactagatgtgAGC | 17943 | 711 |
| 711_1 | 41 | 13 | 41 | 6 | GACcaagcaccttaCA | 17971 | 712 |
| 712_1 | 36 | 19 | 49 | 11 | AGAccaagcacctTAC | 17972 | 713 |
| 713_1 | 30 | 6 | 34 | 7 | ATgggttaaataAAGG | 18052 | 714 |
| 714_1 | 70 | 2 | 24 | 8 | TCaaccagagtattAA | 18067 | 715 |
| 715_1 | 11 | 4 | 26 | 8 | GTCaaccagagtatTA | 18068 | 716 |
| 716_1 | 126 | 56 | 26 | 6 | ATtgtaaagctgaTAT | 18135 | 717 |
| 717_1 | 73 | 1 | 42 | 10 | CAcataattgtaAAGC | 18141 | 718 |
| 718_1 | 23 | 9 | 55 | 18 | GAggtctgctattTAC | 18274 | 719 |
| 719_1 | 50 | 1 | 42 | 11 | TGtagattcaatgCCT | 18404 | 720 |
| 720_1 | 79 | 3 | 39 | 10 | CCtcattatactaTGA | 18456 | 721 |
| 721_1 | 27 | 6 | 30 | 8 | CCttatgctatgacAC | 18509 | 722 |
| 722_1 | 26 | 7 | 50 | 13 | TCCTtatgctatgaCA | 18510 | 723 |
| 723_1 | 59 | 1 | 48 | 12 | AAGatgtttaagtATA | 18598 | 724 |
| 724_1 | 54 | 2 | 50 | 13 | CTgattattaagATGT | 18607 | 725 |
| 725_1 | 92 | 10 | 84 | 19 | TGGaaaggtatgaaTT | 18808 | 726 |
| 726_1 | 24 | 8 | 61 | 16 | ACttgaatggcttGA | 18880 | 727 |
| 727_1 | 8 | 4 | 51 | 14 | AACttgaatggctTGG | 18881 | 728 |
| 728_1 | 35 | 4 | 35 | 10 | CAATgtgttactatTT | 19004 | 729 |

TABLE 10-continued in vitro efficacy of anti-PD-L1 compounds in THP1 and KARPAS-299 cell lines (Average from n = 3 experiments). PD-L1 mRNA levels are normalized to TBP in KARPAS-299 cells or ACTB in THP1 cells and shown as % of control (PBS treated cells).

| CMP ID NO | KARPAS-299 cells 5 µM CMP | | THP1 cells 20 µM CMP | | Compound (CMP) | Start on SEQ ID NO 1 | SEQ ID NO |
|---|---|---|---|---|---|---|---|
| | % mRNA of control | sd | % mRNA of control | sd | | | |
| 729_1 | 36 | 9 | 53 | 11 | ACAatgtgttactATT | 19005 | 730 |
| 730_1 | 70 | 2 | 41 | 11 | CATCtgctatataaGA | 19063 | 731 |
| 731_1 | 38 | NA | 42 | 9 | CCTAgagcaaatacTT | 19223 | 732 |
| 732_1 | 102 | 15 | 15 | 4 | CAGagttaataatAAG | 19327 | 733 |
| 733_1 | 37 | 10 | 8 | 5 | GTTCaagcacaacgAA | 19493 | 734 |
| 734_1 | 13 | 1 | 38 | 11 | AGggttcaagcacAAC | 19496 | 735 |
| 735_1 | 49 | NA | 36 | 11 | TGttggagacactgTT | 19677 | 736 |
| 736_1 | 48 | NA | 32 | 10 | AAGgaggagttaggAC | 19821 | 737 |
| 737_1 | 36 | NA | 64 | 11 | CTATgccatttacgAT | 19884 | 738 |
| 738_1 | 105 | 19 | 66 | 19 | TCaaatgcagaattAG | 19913 | 739 |
| 739_1 | 44 | NA | 41 | 6 | AGtgacaatcaaATGC | 19921 | 740 |
| 740_1 | 107 | NA | 68 | 18 | AAgtgacaatcaaATG | 19922 | 741 |
| 741_1 | 102 | 4 | 27 | 6 | GTGtaccaagtaacAA | 19978 | 742 |
| 742_1 | 110 | 10 | 30 | 16 | TGGgatgttaaacTGA | 20037 | 743 |

Example 2—Testing In Vitro Efficacy in a Dose Response Curve

A selection of oligonucleotides from Table 10 were tested in KARPAS-299 cells using half-log serial dilutions in in PBS (50 µM, 15.8 µM, 5.0 µM, 1.58 µM, 0.5 M, 0.158 µM, 0.05 µM, to 0.0158 µM oligonucleotide) in the in vitro efficacy assay described in Example 1. IC 50 and max inhibition (% residual PD-L1 expression) was assessed for the oligonucleotides.

EC50 calculations were performed in GraphPad Prism6. The IC50 and maximum PD-L1 knock down level is shown in table 11 as % of control (PBS) treated cells.

TABLE 11

Max inhibition as % of saline and EC50 in KARPAS-299 cell line.

| CMP ID NO | Max Inhibition (% residual PD-L1 expression; % of saline-treated) | | EC50 (µM) | | Compound CMP | Start on SEQ ID NO: 1 | SEQ ID NO |
|---|---|---|---|---|---|---|---|
| | Avg | SD | Avg | SD | | | |
| 6_1 | 11 | 3.3 | 0.69 | 0.11 | TCGCataagaatgaCT | 371 | 6 |
| 8_1 | 29 | 1.7 | 0.06 | 0.01 | CTGaacacacagtCGC | 383 | 8 |
| 9_1 | 19 | 1.7 | 0.23 | 0.02 | TCTgaacacacagtCG | 384 | 9 |
| 13_1 | 14 | 4.7 | 0.45 | 0.12 | CTtacttagatgcTGC | 495 | 13 |
| 41_1 | 10 | 1.8 | 0.19 | 0.02 | TCAtttagttaccCAA | 822 | 41 |
| 42_1 | 17 | 1.3 | 0.19 | 0.02 | TTcatttagttaCCCA | 823 | 42 |
| 58_1 | 23 | 1.5 | 0.17 | 0.01 | CCagagatatataTGC | 909 | 58 |
| 77_1 | 24 | 2.4 | 0.16 | 0.02 | AGTatcatagttcTCC | 1075 | 77 |
| 92_1 | 12 | 2.4 | 0.25 | 0.03 | AGattaagacagtTGA | 1310 | 92 |
| 111_1 | 3 | 2.0 | 0.27 | 0.03 | TGaattcccatatcCGA | 1992 | 111 |

TABLE 11-continued

Max inhibition as % of saline and EC50 in KARPAS-299 cell line.

| CMP ID NO | Max Inhibition (% residual PD-L1 expression; % of saline-treated) | | EC50 (µM) | | Compound CMP | Start on SEQ ID NO: 1 | SEQ ID NO |
|---|---|---|---|---|---|---|---|
| | Avg | SD | Avg | SD | | | |
| 128_1 | 11 | 1.8 | 0.25 | 0.03 | CTcatatcagggCAGT | 2063 | 128 |
| 151_1 | 16 | 2.7 | 0.28 | 0.05 | GTCatggattacaaCT | 2324 | 151 |
| 164_1 | 19 | 1.6 | 0.15 | 0.01 | TCTGtttatgtcacTG | 2781 | 164 |
| 166_1 | 36 | 1.7 | 0.11 | 0.02 | TGgtctgtttatGTCA | 2784 | 166 |
| 169_1 | 10 | 1.6 | 0.22 | 0.02 | TTcagcaaatatTCGT | 2995 | 169 |
| 171_1 | 12 | 2.0 | 0.21 | 0.02 | TCTattgttaggtATC | 3053 | 171 |
| 222_1 | 1 | 2.0 | 0.21 | 0.02 | TGacttgtaattgTGG | 5467 | 222 |
| 233_1 | 1 | 4.3 | 0.89 | 0.17 | TGGaatgccctaatTA | 5591 | 233 |
| 245_1 | 4 | 2.0 | 0.17 | 0.02 | TCggttatgttaTCAT | 6470 | 245 |
| 246_1 | 7 | 2.1 | 0.25 | 0.03 | CActttatctggTCGG | 6482 | 246 |
| 250_1 | 0 | 2.5 | 0.23 | 0.03 | CCacatataggtcCTT | 6597 | 250 |
| 251_1 | 0 | 2.8 | 0.75 | 0.10 | CAtattgctaccaTAC | 6617 | 251 |
| 252_1 | 3 | 2.2 | 0.19 | 0.02 | TCAtattgctaccATA | 6618 | 252 |
| 256_1 | 5 | 2.2 | 0.32 | 0.03 | CAAttagtgcagcCAG | 6672 | 256 |
| 272_1 | 1 | 3.2 | 0.69 | 0.10 | TACTgtagaacatgGC | 7133 | 272 |
| 273_1 | 3 | 2.8 | 0.28 | 0.04 | GCAAttcatttgaTCT | 7239 | 273 |
| 287_1 | 1 | 1.4 | 0.13 | 0.01 | ACAAataatggttaCTCT | 7302 | 287 |
| 292_1 | 2 | 2.1 | 0.21 | 0.02 | GCATttgatatagAGA | 7397 | 292 |
| 303_1 | 0 | 1.2 | 0.21 | 0.01 | CAAgatgaatataTGCC | 7551 | 303 |
| 314_1 | 3 | 2.1 | 0.39 | 0.04 | GAgtttggattagCTG | 7764 | 314 |
| 318_1 | 3 | 1.4 | 0.14 | 0.01 | ACAggatatggaaGGG | 7880 | 318 |
| 320_1 | 2 | 2.4 | 0.22 | 0.03 | GAgtaatttcaacAGG | 7891 | 320 |
| 324_1 | 0 | 2.4 | 0.44 | 0.05 | CAgcttactattaGGG | 7906 | 324 |
| 336_1 | 0 | 2.5 | 0.21 | 0.03 | GATGatttaattctagtCA | 7984 | 336 |
| 342_1 | 1 | 2.2 | 0.12 | 0.01 | CAGAttgatggtagTT | 8030 | 342 |
| 343_1 | 4 | 1.8 | 0.11 | 0.01 | CTcagattgatgGTAG | 8032 | 343 |
| 344_1 | 0 | 0.9 | 0.12 | 0.01 | GTTagccctcagaTTG | 8039 | 344 |
| 345_1 | 0 | 2.3 | 0.36 | 0.04 | TGtattgttagcCCTC | 8045 | 345 |
| 346_1 | 1 | 2.1 | 0.22 | 0.02 | ACttgtattgttAGCC | 8048 | 346 |
| 349_1 | 4 | 2.9 | 0.21 | 0.03 | ACAagtggtatcTCT | 8228 | 349 |
| 359_1 | 6 | 2.9 | 0.39 | 0.05 | TTGAtgaggctaagTC | 8395 | 359 |
| 360_1 | 0 | 1.7 | 0.18 | 0.02 | CCAggattatactcTT | 8439 | 360 |
| 374_1 | 5 | 1.7 | 0.33 | 0.03 | AAGatggattgggaGT | 8775 | 374 |
| 408_1 | 3 | 1.8 | 0.21 | 0.02 | TTtgcatatggaGGTG | 8966 | 408 |
| 409_1 | 0 | 1.8 | 0.21 | 0.02 | AAgtgaagttcaaCAGC | 8997 | 409 |

TABLE 11-continued

Max inhibition as % of saline and EC50 in KARPAS-299 cell line.

| CMP ID NO | Max Inhibition (% residual PD-L1 expression; % of saline-treated) | | EC50 (µM) | | Compound CMP | Start on SEQ ID NO: 1 | SEQ ID NO |
|---|---|---|---|---|---|---|---|
| | Avg | SD | Avg | SD | | | |
| 415_1 | 0 | 1.4 | 0.23 | 0.02 | AAttgagtgaatCCAA | 9120 | 415 |
| 417_1 | 7 | 0.9 | 0.15 | 0.01 | GTGataattgagtGAA | 9125 | 417 |
| 424_1 | 6 | 3.2 | 0.19 | 0.03 | CTcattgaaggtTCTG | 9281 | 424 |
| 429_1 | 5 | 2.5 | 0.48 | 0.05 | CAAatagctttatCGG | 9335 | 429 |
| 430_1 | 1 | 2.7 | 0.68 | 0.09 | CCaaatagctttATCG | 9336 | 430 |
| 458_1 | 0 | 4.1 | 0.35 | 0.07 | TGgagtttatattcTAGG | 9512 | 458 |
| 464_1 | 0 | 4.1 | 0.56 | 0.10 | TGCtccagtgtaccCT | 9755 | 464 |
| 466_1 | 1 | 2.1 | 0.21 | 0.02 | CTAattgtagtagtaCTC | 9818 | 466 |
| 474_1 | 0 | 2.4 | 0.27 | 0.03 | GACacactcagatttcAG | 9967 | 474 |
| 490_1 | 0 | 1.9 | 0.29 | 0.03 | TTacttaatttcttTGGA | 10055 | 490 |
| 493_1 | 3 | 1.8 | 0.20 | 0.02 | CTTatgatacaacTTA | 10384 | 493 |
| 512_1 | 0 | 3.3 | 0.63 | 0.10 | GCacaacccagaggAA | 10735 | 512 |
| 519_1 | 5 | 1.5 | 0.15 | 0.01 | TAgatttgtgagGTAA | 11055 | 519 |
| 529_1 | 0 | 2.7 | 0.24 | 0.03 | AGAgcttattcatgtTT | 11197 | 529 |
| 533_1 | 6 | 1.5 | 0.14 | 0.01 | TAGattgtttagtGCA | 11228 | 533 |
| 534_1 | 5 | 0.9 | 0.06 | 0.00 | GTagattgtttaGTGC | 11229 | 534 |
| 547_1 | 1 | 1.6 | 0.26 | 0.02 | TAGGataccacattatGA | 11389 | 547 |
| 566_1 | 0 | 3.0 | 0.40 | 0.06 | ATaaacatgaatctCTCC | 11801 | 566 |
| 567_1 | 2 | 2.5 | 0.34 | 0.04 | CTTtataaacatgaaTCTC | 11804 | 567 |
| 578_1 | 2 | 1.3 | 0.09 | 0.01 | TACAtttattgggcTC | 12081 | 578 |
| 582_1 | 1 | 1.6 | 0.20 | 0.02 | AATCatgttggtacAT | 12092 | 582 |
| 601_1 | 1 | 2.1 | 0.47 | 0.05 | GTAAatggcaggaaCC | 13711 | 601 |
| 619_1 | 4 | 3.4 | 0.44 | 0.08 | TAtgacactgcaTCTT | 15317 | 619 |
| 620_1 | 1 | 1.2 | 0.12 | 0.01 | GTAtgacactgcaTCT | 15318 | 620 |
| 636_1 | 0 | 1.3 | 0.19 | 0.01 | AACAtcagacaacTCTA | 15693 | 636 |
| 638_1 | 0 | 2.2 | 0.36 | 0.04 | TAACatcagacaacTC | 15695 | 638 |
| 637_1 | 0 | 2.1 | 0.21 | 0.02 | TTTAacatcagacaACTC | 15695 | 637 |
| 640_1 | 2 | 3.3 | 0.42 | 0.06 | CCtatttaacatcAGAC | 15700 | 640 |
| 645_1 | 1 | 2.9 | 0.34 | 0.04 | GAtccttatattCTGG | 15854 | 645 |
| 650_1 | 0 | 2.4 | 0.24 | 0.03 | AGgatcttactgtCATT | 15877 | 650 |
| 651_1 | 4 | 3.4 | 0.33 | 0.05 | GCAaatcaactccATC | 15896 | 651 |
| 652_1 | 0 | 1.3 | 0.16 | 0.01 | GTGcaaatcaactCCA | 15898 | 652 |
| 653_1 | 4 | 2.0 | 0.09 | 0.01 | CAATtatttctttgTGC | 15910 | 653 |
| 658_1 | 3 | 1.6 | 0.32 | 0.02 | TCaatagtgtagggCA | 16093 | 658 |
| 659_1 | 5 | 1.4 | 0.20 | 0.01 | TTCaatagtgtaggGC | 16094 | 659 |

TABLE 11-continued

Max inhibition as % of saline and EC50 in KARPAS-299 cell line.

| CMP ID NO | Max Inhibition (% residual PD-L1 expression; % of saline-treated) | | EC50 (μM) | | Compound CMP | Start on SEQ ID NO: 1 | SEQ ID NO |
|---|---|---|---|---|---|---|---|
| | Avg | SD | Avg | SD | | | |
| 660_1 | 4 | 2.1 | 0.22 | 0.02 | AGGTtaattaattcaATAG | 16102 | 660 |
| 665_1 | 3 | 1.8 | 0.18 | 0.02 | GTTtaaatttcaagTTCT | 16185 | 665 |
| 678_1 | 3 | 2.1 | 0.43 | 0.04 | GAgttcttgtgttaGC | 16457 | 678 |
| 679_1 | 0 | 3.5 | 0.31 | 0.05 | ATTaattatccatCCAC | 16590 | 679 |
| 680_1 | 4 | 1.6 | 0.12 | 0.01 | ATCaattaattatcCATC | 16593 | 680 |
| 682_1 | 3 | 2.4 | 0.27 | 0.03 | TGagataccgtgcaTG | 16656 | 682 |
| 683_1 | 0 | 3.2 | 0.16 | 0.03 | AAtgagataccgTGCA | 16658 | 683 |
| 684_1 | 2 | 2.3 | 0.25 | 0.03 | CTGtggttaggctaAT | 16834 | 684 |
| 687_1 | 5 | 1.3 | 0.13 | 0.01 | AGCagatgggttaaGA | 16858 | 687 |
| 694_1 | 0 | 1.7 | 0.16 | 0.02 | GAAtgaaacttgcCTG | 17047 | 694 |
| 706_1 | 15 | 3.6 | 0.27 | 0.06 | GAtgatttgcttGGAG | 17646 | 706 |
| 716_1 | 10 | 2.1 | 0.15 | 0.02 | GTCaaccagagtatTA | 18068 | 716 |
| 728_1 | 5 | 1.2 | 0.09 | 0.01 | AACttgaatggctTGG | 18881 | 728 |
| 733_1 | 0 | 12.7 | 8.01 | 3.62 | CAGagttaataatAAG | 19327 | 733 |
| 734_1 | 0 | 14.6 | 3.49 | 2.39 | GTTCaagcacaacgAA | 19493 | 734 |
| 735_1 | 0 | 2.5 | 0.30 | 0.04 | AGggttcaagcacAAC | 19496 | 735 |

A selection of oligonucleotides from Table 6 were tested in THP-1 cells using 1:3 serial in water from 25 μM to 0.004 μM in the in vitro efficacy assay described in Example 1. IC 50 and max inhibition (Percent residual PD-L1 expresson) was assessed for the oligonucleotides.

EC50 calculations were performed in GraphPad Prism6. The IC50 and maximum PD-L1 knock down level is shown in table 12 as % of control (PBS) treated cells.

TABLE 12

Max inhibition as % of saline and EC50 in THP1 cell line.

| CMP ID NO | Max Inhibition (% residual PD-L1 expression; % of saline) | | EC50 (μM) | | Compound CMP | Start on SEQ ID NO: 1 | SEQ ID NO |
|---|---|---|---|---|---|---|---|
| | Avg | SD | Avg | SD | | | |
| 6_1 | 12 | 11.5 | 0.73 | 0.38 | TCGCataagaatgaCT | 371 | 6 |
| 8_1 | 6 | 5.6 | 0.11 | 0.04 | CTGaacacacagtCGC | 383 | 8 |
| 9_1 | 1 | 14.3 | 0.36 | 0.27 | TCTgaacacacagtCG | 384 | 9 |
| 13_1 | 2 | 12.4 | 0.49 | 0.31 | CTtacttagatgcTGC | 495 | 13 |
| 41_1 | 14 | 14.6 | 0.38 | 0.27 | TCAtttagttaccCAA | 822 | 41 |
| 42_1 | 21 | 10.4 | 0.22 | 0.10 | TTcatttagttaCCCA | 823 | 42 |
| 58_1 | 6 | 19.8 | 0.97 | 0.81 | CCagagatatataTGC | 909 | 58 |

TABLE 12-continued

Max inhibition as % of saline and EC50 in THP1 cell line.

| CMP ID NO | Max Inhibition (% residual PD-L1 expression; % of saline) | | EC50 (µM) | | Compound CMP | Start on SEQ ID NO: 1 | SEQ ID NO |
|---|---|---|---|---|---|---|---|
| | Avg | SD | Avg | SD | | | |
| 77_1 | 5 | 4.8 | 0.14 | 0.04 | AGTatcatagttcTCC | 1075 | 77 |
| 92_1 | 0 | 12.9 | 0.57 | 0.39 | AGattaagacagtTGA | 1310 | 92 |
| 128_1 | 15 | 10.1 | 0.23 | 0.13 | CTcatatcagggCAGT | 2063 | 128 |
| 151_1 | 9 | 14.4 | 0.18 | 0.15 | GTCatggattacaaCT | 2324 | 151 |
| 164_1 | 16 | 22.0 | 0.57 | 0.60 | TCTGtttatgtcacTG | 2781 | 164 |
| 166_1 | 13 | 11.9 | 0.17 | 0.11 | TGgtctgtttatGTCA | 2784 | 166 |
| 169_1 | 0 | 9.3 | 0.22 | 0.11 | TTcagcaaatatTCGT | 2995 | 169 |
| 171_1 | 11 | 12.9 | 0.28 | 0.20 | TCTattgttaggtATC | 3053 | 171 |
| 222_1 | 16 | 19.7 | 0.68 | 0.64 | TGacttgtaattgTGG | 5467 | 222 |
| 245_1 | 14 | 6.1 | 0.26 | 0.08 | TCggttatgttaTCAT | 6470 | 245 |
| 246_1 | 28 | 7.3 | 0.10 | 0.20 | CActttatctggTCGG | 6482 | 246 |
| 252_1 | 19 | 8.0 | 0.29 | 0.12 | TCAtattgctaccATA | 6618 | 252 |
| 272_1 | 3 | 9.7 | 0.25 | 0.14 | TACTgtagaacatgGC | 7133 | 272 |
| 314_1 | 13 | 9.6 | 0.31 | 0.15 | GAgtttggattagCTG | 7764 | 314 |
| 344_1 | 11 | 8.0 | 0.14 | 0.06 | GTTagccctcagaTTG | 8039 | 344 |
| 349_1 | 12 | 12.5 | 0.18 | 0.14 | ACAagtggtatctTCT | 8228 | 349 |
| 415_1 | 11 | 9.6 | 0.26 | 0.12 | AAttgagtgaatCCAA | 9120 | 415 |
| 493_1 | 15 | 16.5 | 0.48 | 0.34 | CTTatgatacaacTTA | 10384 | 493 |
| 512_1 | 43 | 14.1 | 0.31 | 0.68 | GCacaacccagaggAA | 10735 | 512 |
| 519_1 | 9 | 12.2 | 0.45 | 0.26 | TAgatttgtgagGTAA | 11055 | 519 |
| 533_1 | 11 | 13.6 | 0.29 | 0.21 | TAGattgttagtGCA | 11228 | 533 |
| 534_1 | 9 | 6.5 | 0.09 | 0.03 | GTagattgtttaGTGC | 11229 | 534 |
| 582_1 | 0 | 12.3 | 0.33 | 0.23 | AATcatgttggtacAT | 12092 | 582 |
| 619_1 | 8 | 10.4 | 0.32 | 0.18 | TAtgacactgcaTCTT | 15317 | 619 |
| 620_1 | 12 | 24.6 | 1.10 | 1.08 | GTAtgacactgcaTCT | 15318 | 620 |
| 638_1 | 2 | 5.4 | 0.00 | 0.00 | TAAcatcagacaacTC | 15695 | 638 |
| 645_1 | 20 | 29.6 | 1.10 | 1.50 | GAtccttatattCTGG | 15854 | 645 |
| 651_1 | 0 | 11.2 | 0.14 | 0.09 | GCAaatcaactccATC | 15896 | 651 |
| 658_1 | 11 | 13.8 | 0.48 | 0.32 | TCaatagtgtagggCA | 16093 | 658 |
| 659_1 | 0 | 8.2 | 0.11 | 0.06 | TTCaatagtgtaggGC | 16094 | 659 |
| 733_1 | 0 | 69.6 | 11.03 | 26.95 | CAGagttaataatAAG | 19327 | 733 |
| 734_1 | 36 | 16.8 | 2.84 | 2.12 | GTTCaagcacaacgAA | 19493 | 734 |

Figure 2:
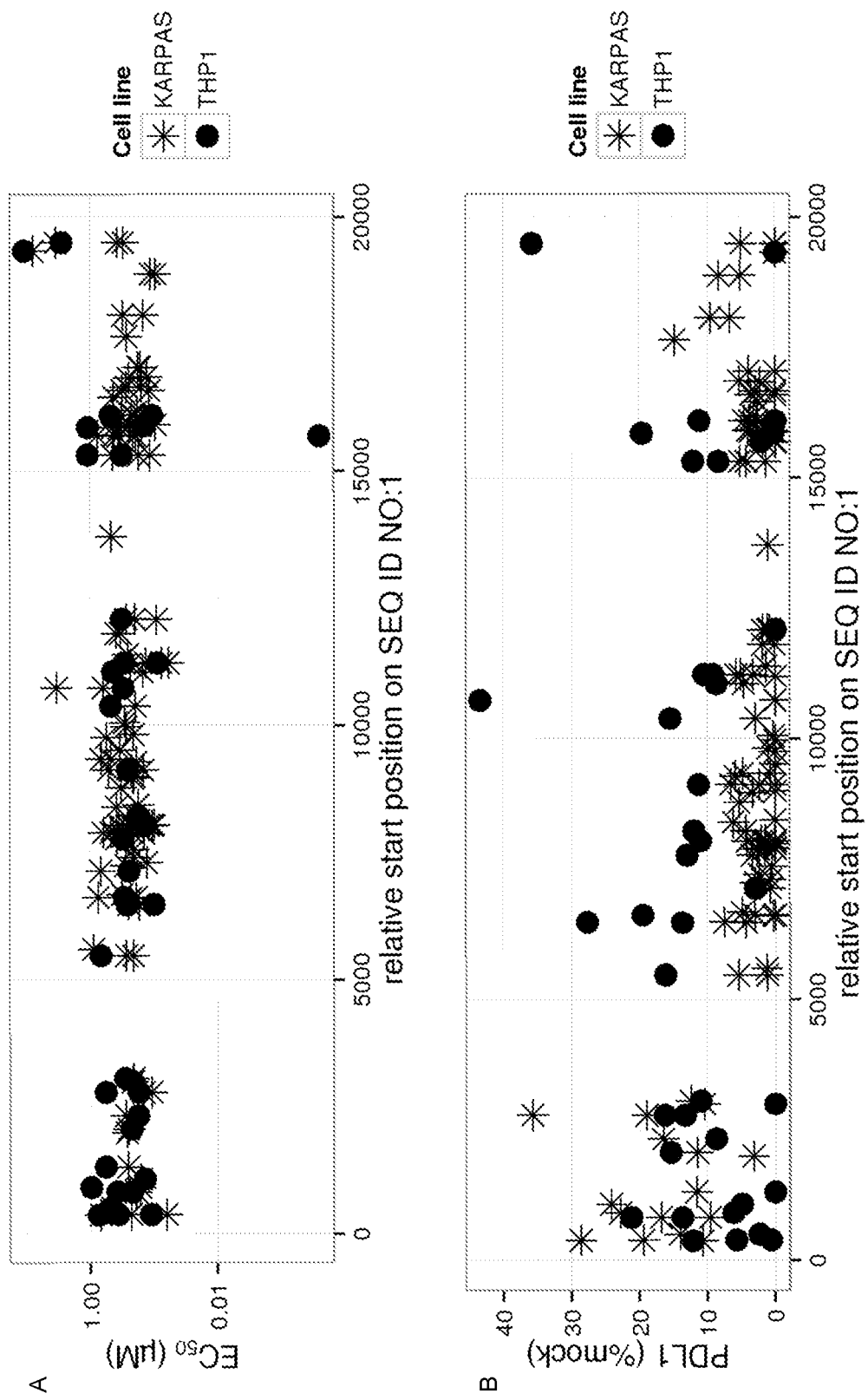
FIG. 2: Graph showing EC50 (A) and PD-L1 knock down as % of saline (B) for the compounds tested in Example 2, in relation to their position on the target nucleic acid. The cell line in which the compound were tested are THP1(●) and Karpas (✽).

The results in table 7 and 8 are also shown in FIG. 2 in relation to their position where they target the PD-L1 pre mRNA of SEQ ID NO: 1.

From this it can be seen that almost all of the compounds have EC50 values below 1 µM and a target knock down below 25% of the PD-L1 expression level in the control cells (treated with saline).

Example 3—In Vitro Potency and Efficacy and In Vivo PD-L1 Reduction in poly(I:C) Induced Mice Using Naked and GalNAc Conjugated PD-L1 Antisense Oligonucleotides Efficacy and potency testing was performed in an in vitro experiment in in dose-response studies in MCP-11 cells using the oligonucleotides in table 6. The same oligonucleotides as well as GalNAc conjugated versions (Table 8 CMP ID NO 755_2-765_2) were tested in vivo in poly(I:C) induced C57BL/6J female mice for their ability to reduce PD-L1 mRNA and protein expression In Vitro Assay MCP-11 cells (originally purchased from ATCC) suspended in DMEM (Sigma cat. no. D0819) supplemented with 10% horse serum, 2 mM L-glutamine, 0.025 mg/ml gentamicin and 1 mM sodium pyruvate were added at a density of 8000 cells/well to the oligonucleotides (10 µl) in 96-well round bottom plates and cultured for 3 days in a final volume of 200 µl/well in a humidified incubator at 37° C. with 5% $CO_2$. Oligonucleotides were screened in dose-range concentrations (50 µM, 15.8 µM, 5.0 µM, 1.58 µM, 0.5 µM, 0.158 µM, 0.05 µM and 0.0158 µM).

Total mRNA was extracted using the PureLink Pro 96 RNA Purification kit (Ambion), according to the manufacturer's instructions. cDNA was synthesized using M-MLT Reverse Transcriptase, random decamers RETROscript, RNase inhibitor (Ambion) and 100 mM dNTP set (Invitrogen, PCR Grade) according to the manufacturer's instruction. For gene expressions analysis, qPCR was performed using TaqMan Fast Advanced Master Mix (2×) (Ambion) in a duplex set up with TaqMan primer assays for the PD-L1 (Thermo Fisher Scientific; FAM-MGB Mm00452054-m1) and Gusb (Thermo Fisher Scientific; VIC-MGB-PL Mm01197698-m1). The relative PD-L1 mRNA expression level is shown in table 9 as % of residual PD-L1 expression in % of PBS control samples (PBS-treated cells). EC50 calculations were performed in GraphPad Prism6. The EC50 and maximum PD-L1 knockdown level is shown in table 13 as % of control (PBS) cells.

In Vivo Assay

C57BL/6J female mice (20-23 g; 5 mice per group) were injected s.c. with 5 mg/kg unconjugated oligonucleotides to mouse PD-L1 or 2.8 mg/kg GalNAc-conjugated oligonucleotides to mouse PD-L1. Three days later, the mice were injected i.v. with 10 mg/kg poly(I:C) (LWM, Invivogen). The mice were sacrificed 5 h after poly(I:C) injection and liver samples were placed in RNAlater (Thermo Fisher Scientific) for RNA extraction or frozen at dry ice for protein extraction.

Total mRNA was extracted from homogenized liver samples using the PureLink Pro 96 RNA Purification kit (Ambion), according to the manufacturer's instructions. cDNA was synthesized using M-MLT Reverse Transcriptase, random decamers RETROscript, RNase inhibitor (Ambion) and 100 mM dNTP set (Invitrogen, PCR Grade) according to the manufacturer's instruction. For gene expressions analysis, qPCR was performed using TaqMan® Fast Advanced Master Mix TaqMan Fast Advanced Master Mix (2×) (Ambion) in a duplex set up with TaqMan primer assays for the PD-L1 mRNA (Thermo Fisher Scientific; FAM-MGB Mm00452054-m1) and TBP (Thermo Fisher Scientific; VIC-MGB-PL Mm00446971_m1). The relative PD-L1 mRNA expression level is shown in table 13 as % of control samples from mice injected with saline and poly(I:C).

Liver homogenates were prepared by homogenizing liver samples in 2 ml per 100 mg tissue T-PER® Tissue Protein Extraction Reagent (Thermo Fisher Scientific) mixed with 1× Halt Protease Inhibitor Cocktail, EDTA-Free (Thermo Fisher Scientific). Protein concentrations in liver homogenates were measured using Coomassie Plus (Bradford) Assay Reagent (Thermo Scientific) according to the manufacturer's instructions. Liver homogenates (40 µg protein) were separated on 4-12% Bis-Tris Plus polyacrylamide gels (Thermo Fisher Scientific) in 1×MOPS running buffer and transferred to nitrocellulose membranes using iBLOT Dry blotting system (Thermo Fisher Scientific) according to the manufacturer's instructions. Each blot was cut in to two parts horizontally at the 64 kDa band. Following blocking in TBS containing 5% skim milk and 0.05% Tween20, the membranes were incubated overnight at 4° C. with rabbit monoclonal anti-vinculin (Abcam cat. no. ab129002) diluted 1:10000 (upper membranes) or goat polyclonal anti-mPD-L1 (R&D Systems cat. no. AF1019) diluted 1:1000 (lower membranes) in TBS containing 5% skim milk and 0.05% Tween20. The membranes were washed in TBS containing 0.05% Tween20 and exposed for 1 h at room temperature to HRP-conjugated swine anti-rabbit IgG (DAKO) diluted 1:3000 (upper membranes) or HRP-conjugated rabbit anti-goat IgG (DAKO) diluted 1:2000 in TBS containing 5% skim milk and 0.05% Tween20. Following washing of the membranes, the reactivity was detected using ECL select (Amersham GE Healthcare). For each group of mice treated with oligonucleotides, the intensity of the PD-L1 bands in relation to vinculin bands were evaluated by comparison with the PD-L1/vinculin band intensities of mice injected with saline and poly(I:C) (control). Results are shown in table 13, and western blots with pairs of naked and conjugated oligonucleotides are shown in FIG. 9A-E.

TABLE 13

In vitro and in vivo efficacy of oligonucleotides to mouse PD-L1

| CMP ID NO | Compound CMP | Max Inhibition (% of PBS) | EC50 (µM) | PD-L1 mRNA (% of control) | PD-L1 protein (relative to control) | SEQ ID NO |
|---|---|---|---|---|---|---|
| 744_1 | AGTttacattttcTGC | 9.1 | 0.56 | 86 | ++ | 744 |
| 746_1 | CACctttaaaaccCCA | 5.0 | 0.46 | 181 | nd | 746 |
| 747_1 | TCCtttataatcaCAC | 4.4 | 0.52 | 104 | ++ | 747 |
| 748_1 | ACGgtattttcacAGG | 1.8 | 0.26 | 102 | +++ | 748 |

TABLE 13-continued

In vitro and in vivo efficacy of oligonucleotides to mouse PD-L1

| CMP ID NO | Compound CMP | Max Inhibition (% of PBS) | EC50 (µM) | PD-L1 mRNA (% of control) | PD-L1 protein (relative to control) | SEQ ID NO |
|---|---|---|---|---|---|---|
| 749_1 | GACactacaatgaGGA | 7.6 | 1.21 | 104 | nd | 749 |
| 750_1 | TGGtttttaggacTGT | 12.4 | 0.74 | 84 | nd | 750 |
| 751_1 | CGAcaaattctatCCT | 9.9 | 0.69 | 112 | nd | 751 |
| 752_1 | TGAtatacaatgcTAC | 10.5 | 1.11 | 142 | +++ | 752 |
| 753_1 | TCGttgggtaaatTTA | 5.7 | 0.53 | 116 | +++ | 753 |
| 754_1 | TGCtttataaatgGTG | 5.2 | 0.35 | 98 | nd | 754 |
| 755_2 | 5'-GN2-C6-caAGTttacattttcTGC | nd | nd | 58 | + | 744 |
| 757_2 | 5'-GN2-C6-caCACcttttaaaaccCCA | nd | nd | 62 | nd | 746 |
| 758_2 | 5'-GN2-C6-caTCCtttataatcaCAC | nd | nd | 53 | + | 747 |
| 759_2 | 5'-GN2-C6-caACGgtattttcacAGG | nd | nd | 66 | + | 748 |
| 760_2 | 5'-GN2-C6-caGACactacaatgaGGA | nd | nd | 101 | nd | 749 |
| 761_2 | 5'-GN2-C6-caTGGtttttaggacTGT | nd | nd | 99 | nd | 750 |
| 762_2 | 5'-GN2-C6-caCGAcaaattctatCCT | nd | nd | 84 | nd | 751 |
| 763_2 | 5'-GN2-C6-caTGAtatacaatgcTAC | nd | nd | 93 | +++ | 752 |
| 764_2 | 5'-GN2-C6-caTCGttgggtaaatTTA | nd | nd | 53 | + | 753 |
| 765_2 | 5'-GN2-C6-caTGCtttataaatgGTG | nd | nd | 106 | nd | 754 |

+++: similar to PD-L1/vinculin band intensity of control;
++: weaker than PD-L1/vinculin band intensity of control;
+: much weaker than PD-L1/vinculin band intensity of control;
nd= not determined.

From the data in table 13 it can be seen that GalNAc conjugation of the oligonucleotides clearly improves the in vivo PD-L1 reduction. The reduction of mRNA generally correlates with a reduction in PD-L1 protein. Except for CMP ID NO: 754_1, a low in vitro EC50 value generally reflects a good in vivo PD-L1 mRNA reduction once the oligonucleotide is conjugated to GalNAc.

Example 4—In Vivo PK/PD in Sorted Hepatocytes and Non-Parenchymal Cells from poly(I:C) Induced Mice The distribution of naked and GalNAc conjugated oligonucleotides as well as PD-L1 mRNA reduction was investigated in hepatocytes and non-parenchymal cells isolated from poly(I:C) induced mice.

C57BL/6J female mice (n=3 per group) were injected s.c. with 5 mg/kg unconjugated oligonucleotide (748_1) or 7 mg/kg GalNAc-conjugated oligonucleotides (759_2) targeting mouse PD-L1 mRNA. Two days later, the mice were injected i.p. with 15 mg/kg poly(I:C) (LWM, Invivogen). The mice were anesthesized 18-20 h after poly(I:C) injection and the liver was perfused at a flow rate of 7 ml per min through the vena cava using Hank's balanced salt solution containing 15 mM Hepes and 0.38 mM EGTA for 5 min followed by collagenase solution (Hank's balanced salt solution containing 0.17 mg/ml Collagenase type 2 (Worthington 4176), 0.03% BSA, 3.2 mM $CaCl_2$) and 1.6 g/l $NaHCO_3$) for 12 min. Following perfusion, the liver was removed and the liver capsule was opened, the liver suspension was filtered through 70 µm cell strainer using William E medium and an aliquot of the cell suspension (=mixed liver cells) was removed for later analysis. The rest of the cell suspension was centrifuged for 3 min at 50×g. The supernatant was collected for later purification of non-parenchymal cells. The pellet was resuspended in 25 ml William E medium (Sigma cat. no. W1878 complemented with 1× Pen/Strep, 2 mM L-glutamine and 10% FBS (ATCC #30-2030)), mixed with 25 ml William E medium containing 90% percoll and the hepatocytes were precipitated by centrifugation at 50×g for 10 min. Following 2× washing in William E medium, the precipitated hepatocytes were resuspended in Williams E medium. The supernant containing non-parenchymal cells was centrifuged at 500×g 7 min and the cells were resuspended in 4 ml RPMI medium and centrifugated through two layers of percoll (25% and 50% percoll) at 1800×g for 30 min. Following collection of the non-parenchymal cells between the two percoll layers, the cells were washed and resuspended in RPMI medium.

Total mRNA was extracted from purified hepatocytes, non-parenchymal cells and total liver suspension (non-fractionated liver cells) using the PureLink Pro 96 RNA Purification kit (Ambion), according to the manufacturer's instructions. cDNA was synthesized using M-MLT Reverse Transcriptase, random decamers RETROscript, RNase inhibitor (Ambion) and 100 mM dNTP set (Invitrogen, PCR Grade) according to the manufacturer's instruction. For gene expressions analysis, qPCR was performed using TaqMan Fast Advanced Master Mix (2×) (Ambion) in a duplex set up with TaqMan primer assays for the PD-L1 (Thermo Fisher Scientific; FAM-MGB Mm00452054-m1) and TBP (Thermo Fisher Scientific; VIC-MGB-PL Mm00446971_m1). The relative PD-L1 mRNA expression level is shown in table 10 as % of control samples from mice injected with saline and poly(I:C).

Oligonucleotide content analysis was performed using ELISA employing a biotinylated capture probe with the sequence 5'-TACCGT-s-Bio-3' and a digoxigenin conjugated detection probe with the sequence 5'-DIG-C12-S1-CCTGTG-3'. The probes consisted of only LNA with a phosphodiester backbone. Liver samples (approximately 50 mg) were homogenized in 1.4 mL MagNa pure lysis buffer (Roche Cat. No 03604721001) in a 2 mL Eppendorf tube containing one 5 mm stainless steel bead. Samples were homogenized on Retsch MM400 homogenizer (Merck Eurolab) until a uniform lysate was obtained. The samples were incubated for 30 min at room temperature. Standards were generated by spiking the unconjugated antisense oligonucleotide compound (CMP ID NO 748_1) in defined concentrations into an untreated liver sample and processing them as the samples. Spike-in concentrations are chosen to match the expected sample oligo content (within ~10-fold).

The homogenized samples were diluted a minimum of 10 times in 5×SSCT buffer (750 mM NaCl, and 75 mM sodium citrate, containing 0.05% (v/v) Tween-20, pH 7.0) and a dilution series of 6 times 2 fold dilutions using capture-detection solution (35 nM capture probe and 35 nM detection probe in 5×SSCT buffer) were made and incubated for 30 min at room temperature. The samples were transferred to a 96 well streptavidin coated plate (Nunc Cat. No. 436014) with 100 µL in each well. The plates were incubated for 1 hour at room temperature with gentle agitation. Wash three times with 2×SSCT buffer and add 100 µl anti-DIG-AP Fab fragment (Roche Applied Science, Cat. No. 11 093 274 910) diluted 1:4000 in PBST (Phosphate buffered saline, containing 0.05% (v/v) Tween-20, pH 7.2, freshly made) was added to each well and incubated for 1 hour at room temperature under gentle agitation. Wash three times with 2×SSCT buffer and add 100 µL of alkaline phosphatase (AP) substrate solution (Blue Phos Substrate, KPL product code 50-88-00, freshly prepared). The intensity of the color was measured spectrophotometrically at 615 nm after 30 minutes incubation with gentle agitation. Raw data were exported from the readers (Gen5 2.0 software) to excel format and further analyzed in excel. Standard curves were generated using GraphPad Prism 6 software and a logistic 4 PL regression model.

TABLE 14

PD-L1 expression and oligo content in total liver suspension, hepatocytes and non-parenchymal cells from poly(I:C) mice treated with unconjugated and GalNAc-conjugated oligonucleotides, n = 3.

| Cell type | CMP ID no | PD-L1 expression (% of saline- poly(I:C)) Avg | SD | oligo content (ng/10⁵ cells) Avg | SD |
|---|---|---|---|---|---|
| Total liver | 748_1 | 31 | 12.4 | 2.3 | 0.3 |
| | 759_2 | 28 | 5.3 | 8.3 | 1.1 |
| Hepatocytes | 748_1 | 33 | 8.0 | 5.1 | 3.7 |
| | 759_2 | 7 | 1.0 | 43.8 | 18.9 |
| Non-parenchymal cells | 748_1 | 31 | 10.1 | 2.2 | 0.7 |
| | 759_2 | 66 | 1.6 | 1.7 | 0.9 |

The results show that naked (CMP ID NO: 748_1) and conjugated (CMP ID NO: 759_2) oligonucleotide reduce PD-L1 mRNA equally well in total liver cells. In isolated hepatocytes, the effect of the conjugated oligonucleotide is almost 5 fold stronger than the effect of the naked oligonucleotide, while naked oligonucleotides showed two fold stronger effect than GalNAc-conjugated oligonucleotides in non-parenchymal cells. In hepatocytes and non-parenchymal cells the reduction of PD-L1 mRNA expression correlates to some extent with the oligonucleotide content in these cell types.

Example 5—In Vivo PD-L1 Knock Down in AAV/HBV Mice Using Naked and GalNAc Conjugated PD-L1 Antisense Oligonucleotides In the present study AAV/HBV mice were treated with naked or conjugated to GalNAc PD-L1 antisense oligonucleotides, and the PD-L1 mRNA expression and HBV gene expression was evaluated in the liver.

Female HLA-A2/DR1 mice 5-8 weeks old (5 animals pr. group) were pretreated at week-1 vehicle (saline), naked PD-L1 antisense oligonucleotides (CMP ID NO 752_1 at 5 mg/kg s.c.) and GalNAc PD-L1 antisense oligonucleotides (CMP ID NO 763_2 at 7 mg/kg s.c.), these doses correspond to equimolar concentrations of the oligonucleotides. The mice were transduced by $5×10^{10}$ vg AAV-HBV at week 0 (for further details see description AAV/HBV mouse model in the Materials and Methods section). From W1 post AAV-HBV transduction to W4, mice received 4 additional s.c. injections of PD-L1 oligonucleotides or vehicle (saline solution), given one week apart.

Blood samples were taken one week before transduction and one week after each injection.

Mice were sacrificed two weeks after the last injections and their liver were removed following PBS perfusion. The liver was cut in smaller pieces and directly frozen.

To measure HBV gene expression, DNA was extracted from serum with Qiagen Biorobot using the QIAamp One for all nucleic acid kit, Cat. #965672, serum was diluted 1:20 dilution in PBS a total of 100 µl was lysed in 200 µl Buffer AL. DNA was eluted from the kit in 100 µl.

For the Real-Time qPCR the TaqMan Gene Expression Master Mix (cat. #4369016, Applied Biosystems) was used together with a primer mix prepared by adding 1:1:0.5 of the following primers F3_core, R3_core, P3_core (Integrated DNA Technologies, all reconstituted at 100 µM each)

Forward (F3_core):
(SEQ ID NO: 784)
CTG TGC CTT GGG TGG CTT T

Reverse (R3_core):
(SEQ ID NO: 785)
AAG GAA AGA AGT CAG AAG GCA AAA

Probe (P3_core):
(SEQ ID NO: 786)
56-FAM-AGC TCC AAA/ZEN/TTC TTT ATA AGG GTC GAT GTC CAT G-3IABKFQ A standard curve using HBV plasmid (Genotype D, GTD) was prepared using 10-fold dilutions starting with $1×10^9$ copies/µl down to 1 copy/µl and used in 5 µl per reaction.

For each reaction 10 µl Gene Expression Master Mix, 4.5 µl water, 0.5 µl Primer mix and 5 µl sample or standard was added and the qPCR was run.

For the analysis the copy number/ml/well was calculated using the standard curve. The results are shown in table 15.

PD-L1 mRNA expression was measured using qPCR.

mRNA was extracted from frozen liver pieces that were added to 2 ml tubes containing ceramic beads (Lysing Matrix D tubes, 116913500, mpbio) and 1 ml of Trizol.

The liver piece was homogenized using the Precellys Tissue Disruptor. 200 µl Chloroform was added to the homogenate, vortexed and centrifuged at 4° C. for 20 min at 10000 rpm. The RNA containing clear phase (around 500 µl) was transferred into a fresh tube and the same volume of 70% EtOH was added. After mixing well the solution was transferred onto a RNeasy spin column and RNA was further extracted following the RNeasy Kit's manual RNeasy Mini Kit, cat. #74104, Qiagen (including the RNA digestion RNase-free DNase Set, cat. #79254). Elution in 50 µl H₂O. The final RNA concentration was measured and adjusted to 100 ng/ul for all samples.

The qPCR was conducted on 7.5 µl RNA using the Taqman RNA-to-ct 1-step Kit, cat. #4392938, Thermo Fisher according to the manufactures instructions. The fprimer mixed used contained PD-L1_1-3 (Primer number Mm00452054_m1, Mm03048247_m1 and Mm03048248_m1) and endogounous controls (ATCB Mm00607939_s1, CANX Mm00500330_m1, YWHAZ Mm03950126_s1 and GUSB Mm01197698_m1)

Data were analysed using the 2^-ddct method. The mean of all four endogenous controls was used to calculate dct values. The PD-L1 expression relative to mean of the endogenous controls and in % of saline

TABLE 15

PD-L1 mRNA expression and HBV DNA in AAV/HBV mice treated with unconjugated and GalNAc-conjugated oligonucleotides, n = 5.

| | CMP ID no | PD-L1 mRNA expression (% of saline) | | HBV DNA expression (% of saline) | |
|---|---|---|---|---|---|
| | | Avg | SD | Avg | SD |
| Naked | 752_1 | 55 | 35 | 72 | 16 |
| GalNAc conjugated | 763_2 | 34 | 3 | 79 | 9 |

From these results it can be seen that both naked and GalNAc conjugated oligonucleotides are capable of reducing PD-L1 mRNA expression in the liver of an AAV/HBV mouse, with the GalNAc conjugated oligonucleotide being somewhat better. Both oligonucleotides also resulted in some reduction in HBV DNA in the serum.

Example 6—In Vivo Effect on T Cell Response in AAV/HBV Mice

In the present study AAV/HBV mice from Pasteur were treated with an antibody or antisense oligonucleotides targeting PD-L1. The antisense oligonucleotides were either naked or conjugated to GalNAc. During the treatment the animals were immunized with a DNA vaccine against HBs and HBc antigens (see Materials and Methods section) to ensure efficient T cell priming by the antigen presenting cells. It was evaluated how the treatment affected the cell population in liver and spleen, as well as the PD-L1 expression on these populations and whether a HBV specific T cell response could be identified.

Treatment Protocol:

Female HLA-A2/DR1 mice were treated according to the protocols below. The study was conducted in two separate sub-studies, with slight differences in the administration regimens as indicated in Table 16 and 17 below.

DNA vaccine and anti-PD-L1 antibody was administered as described in the materials and method section. The antisense oligonucleotides used were CMP ID NO 748_1 (naked) at 5 mg/kg and CMP ID NO: 759_2 (GalNAc conjugated) at 7 mg/kg, both where administered as subcutaneous injections (s.c.).

TABLE 16

AAV/HBV mouse treatment protocol with DNA vaccine and DNA vaccine + anti-PD-L1 antibody, 6 mice in each group

| Day | Vehicle (Group 10) | DNA vaccine (Group 11) | DNA vaccine + anti-PDL-1 Ab (Group 13) |
|---|---|---|---|
| 0 | | AAV/HBV | |
| 29* | | Animal randomization | |
| 34 | Saline + Isotype | — | Ab |
| 41 | Saline + Isotype | — | Ab |
| 48 | Saline + Isotype | — | Ab |
| 50 | — | CaTx | CaTx |
| 55* | PBS + Isotype | DNA | DNA + Ab |
| 62 | Saline + Isotype | — | Ab |
| 69 | PBS + Isotype | DNA | DNA + Ab |
| 76* | Saline + Isotype | — | Ab |
| 83 | Saline + Isotype | — | Ab |
| 97* | | Sacrifice | |

Isotype = mouse IgG control Ab,
CaTx = cardiotoxine,
DNA = DNA vaccine,
Ab = anti-PD-L1 Ab and
*= serum collection

TABLE 17

AAV/HBV mouse treatment protocol with DNA vaccine and DNA vaccine + naked or conjugated PD-L1 oligonucleotide (ASO), 7 mice in each group

| Day | Vehicle (Group 1) | DNA vaccine (Group 2) | DNA vaccine + PDL-1 ASO (Group 7) | DNA vaccine + GN-PDL-1 ASO (Group 8) |
|---|---|---|---|---|
| 0 | | AAV/HBV | | |
| 29* | | Animal randomization | | |
| 39 | Saline | Saline | | |
| 41 | | Saline | ASO | GN-ASO |
| 46 | Saline | Saline | | |
| 49 | | Saline | ASO | GN-ASO |
| 53 | Saline | Saline | | |
| 55 | CaTx | CaTx | CaTx | CaTx |
| 56 | | Saline | ASO | GN-ASO |
| 59 | PBS + Saline | DNA + PBS | DNA | DNA |
| 62* | | Saline | ASO | GN-ASO |
| 67 | Saline | Saline | | |
| 70 | | Saline | ASO | GN-ASO |
| 74 | PBS + Saline | DNA + PBS | DNA | DNA |
| 77 | | Saline | ASO | GN-ASO |
| 81 | Saline | Saline | | |
| 84* | | Saline | ASO | GN-ASO |
| 88 | Saline | Saline | | |
| 91 | | Saline | ASO | GN-ASO |
| 102 | | Sacrifice | | |

DNA = DNA vaccine,
CaTx = cardiotoxine,
Ab = anti-PD-L1 Ab,
ASO = naked PDL-1 oligonucleotide,
GN-ASO = GalNAc-PDL-1 oligonucleotide and
*= serum collection At the time of sacrifice blood, spleen and liver mononuclear cells of each mouse from each group were collected and depleted of red blood cells (Lysing Buffer, BD biosciences, 555899).

The liver mononuclear cells required a specific preparation as described in the materials and method section.

Cell Populations:

In the liver the cell population was analyzed by surface labeling on liver mononuclear cells (see materials and methods) using cytometry.

Figure 10:
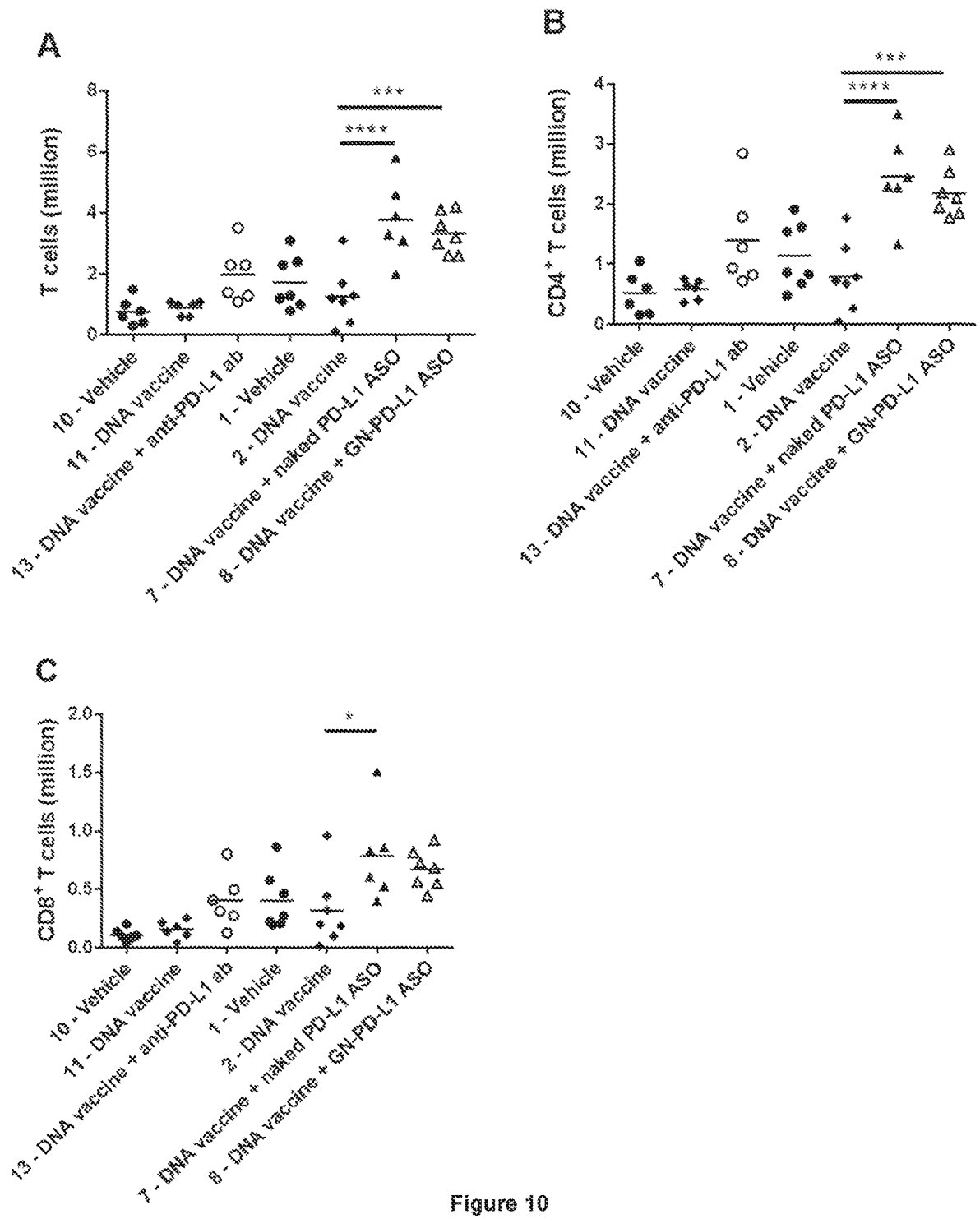
FIG. 10: Population of mononuclear cells in the liver after treatment with ● vehicle (group 10 and 1), ◆ DNA vaccine (group 11 and 2), ○ anti-PD-L1 antibody (group 12), ▲ naked PD-L1 ASO+DNA vaccine (group 7) or Δ GalNAc conjugated PD-L1 ASO+DNA vaccine (group 8), for each group the individual animals are represented and the average is indicated by the vertical line for each group (see table 18). Statistical significance between the DNA vaccine group and the three treatment groups has been assessed and if present it is indicated by * between the groups (*=P<0.05, *=P<0.001 and **=P<0.0001). A) represents the number of T cells in the liver following treatment. B) represents the fraction of CD4+ T cells and C) represents the fraction of CD8+ T cells.
Figure 10:
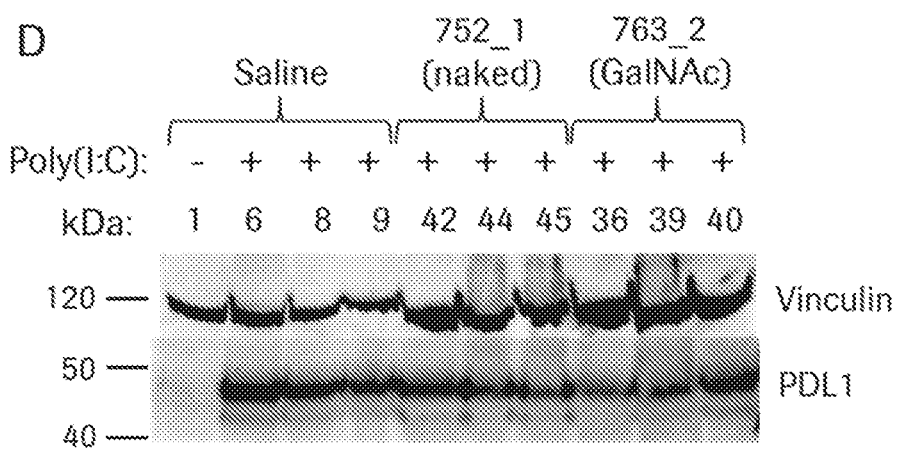
Figure 10:
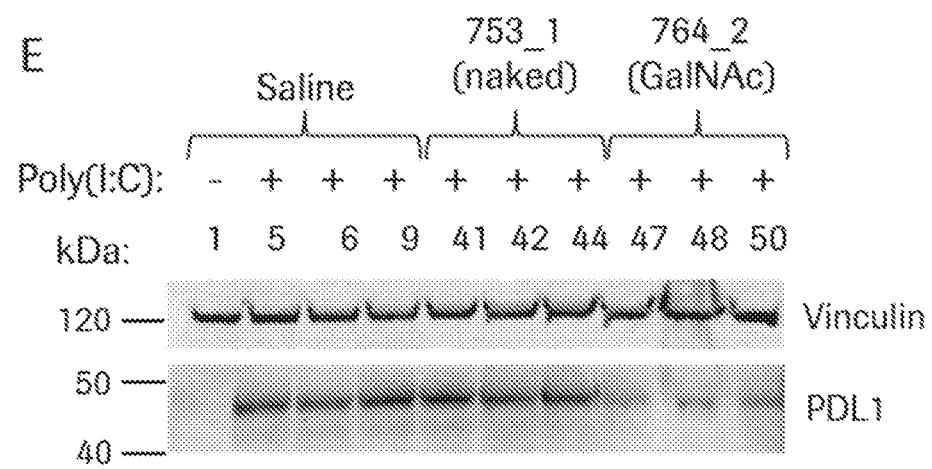

No significant changes were noticed in the frequencies of NK cells in the spleen and liver of treated mice compared to control groups (i.e. vehicle and DNA-immunized groups). Table 18 show that in the liver, groups treated with naked PD-L1 oligonucleotide (CMP ID NO 748_1) and GalNAc conjugated PD-L1 oligonucleotide (CMP ID NO: 759_2) had a significant increase in T cell numbers compared to either control groups (i.e. vehicle and DNA-immunized groups) also presented in FIG. 10A. This increase was due to an increase in both CD4+ and CD8+ T cell populations (Table 18 and FIGS. 10B and 10C, respectively).

TABLE 18

T-cells in the liver following treatment in millions of cells

|  | T-cells (millions) | | CD4+ T-cells (millions) | | CD8+ T-cells (millions) | |
| --- | --- | --- | --- | --- | --- | --- |
|  | Avg | Std | Avg | Std | Avg | Std |
| Vehicle (Group 1) | 0.77 | 0.44 | 0.51 | 0.35 | 0.11 | 0.05 |
| DNA vaccine (Group 2) | 0.90 | 0.24 | 0.58 | 0.16 | 0.16 | 0.08 |
| DNA vaccine + anti-PD-L1 Ab (Group 13) | 1.98 | 0.90 | 1.40 | 0.81 | 0.41 | 0.23 |
| Vehicle (Group 10) | 1.73 | 0.87 | 1.13 | 0.55 | 0.40 | 0.25 |
| DNA vaccine (Group 11) | 1.27 | 0.97 | 0.79 | 0.58 | 0.32 | 0.32 |
| DNA vaccine + PD-L1 ASO (Group 7) | 3.78 | 1.31 | 2.46 | 0.72 | 0.79 | 0.39 |
| DNA vaccine + GN-PD-L1 ASO (Group 8) | 3.33 | 0.66 | 2.18 | 0.40 | 0.67 | 0.17 |

PD-L1 Expression:

The expression of PD-L1 protein was evaluated on macrophages, B and T cells from spleen and liver at time of sacrifice. The presence of PD-L1 antibody in the surface labeling antibody mix (see materials and methods) allowed quantification of PD-L1 expressing cells by cytometry.

In spleen, no significant difference between the treatments was observed in the % of macrophages, B cells and CD4+ T cells expressing PD-L1. The % of the CD8+ T cells expressing PD-L1 was lower in mice treated with naked PD-L1 oligonucleotide (CMP ID NO 748_1) and GalNAc conjugated PD-L1 oligonucleotide (CMP ID NO: 759_2) when compared to the other treatments (data not shown).

Figure 11:
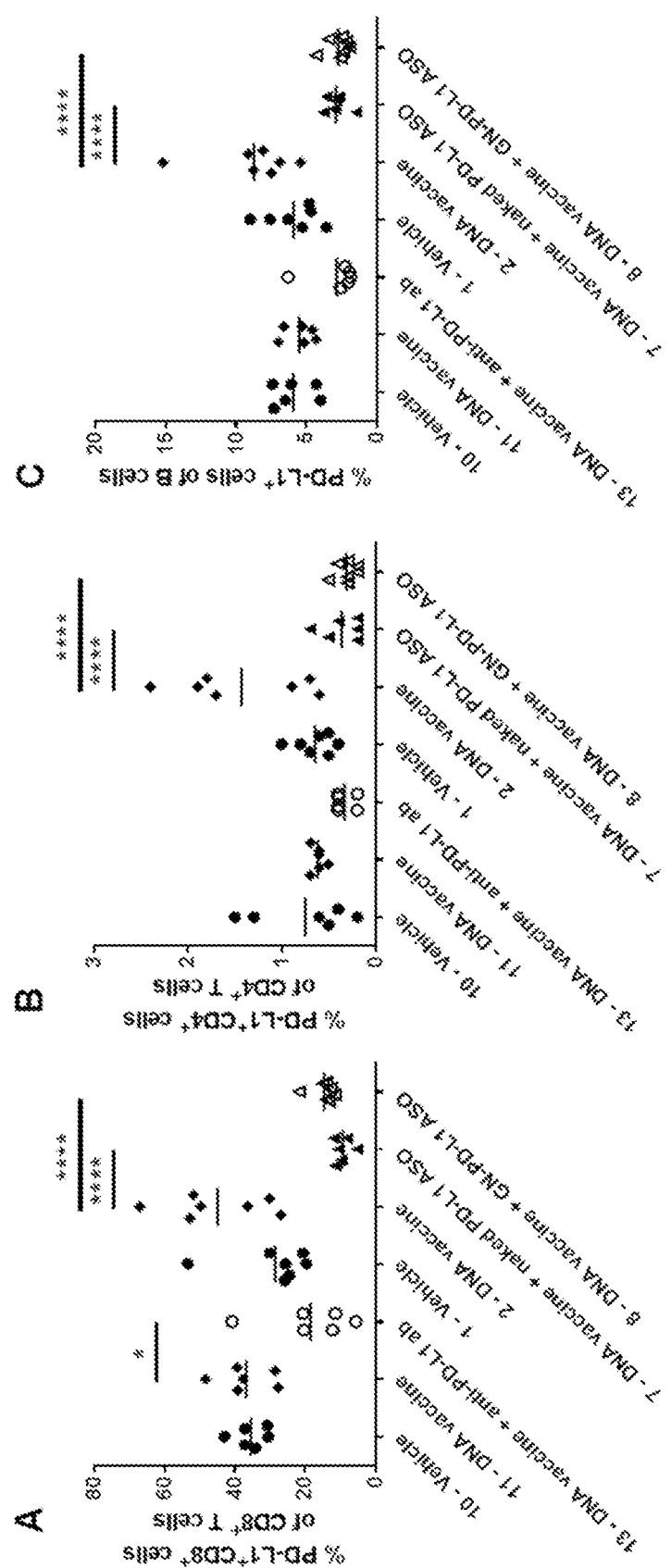
FIG. 11: Modulation of PD-L1 positive cells in the liver after treatment with ● vehicle (group 10 and 1), ◆ DNA vaccine (group 11 and 2), ○ anti-PD-L1 antibody (group 12), ▲ naked PD-L1 ASO+DNA vaccine (group 7) or Δ GalNAc conjugated PD-L1 ASO+DNA vaccine (group 8), for each group the individual animals are represented and the average is indicated by the vertical line for each group (see table 19). Statistical significance between the DNA vaccine group and the three treatment groups has been assessed and if present it is indicated by * between the groups (*=P<0.05 and ****=P<0.0001). A) represents the percentage of CD8+ T cells which express PD-L1 in the liver following treatment. B) represents the percentage of CD4+ T cells which express PD-L1 in the liver following treatment and C) represents the percentage of B cells which express PD-L1 in the liver following treatment.

In liver, PD-L1 was expressed mainly on CD8+ T cells with a mean frequency of 32% and 41% in the control groups (the two vehicle and DNA vaccination groups combined, respectively, FIG. 11A). Treatment with naked PD-L1 oligonucleotide or GalNAc PD-L1 oligonucleotide resulted in a decrease of the frequency of CD8+ T cells expressing PD-L1 (see table 19 FIG. 11A). Significant differences in the % of cells expressing PD-L1 were also noticed for B cells and CD4+ T-cells after ASO treatment, although these cell types express significantly less PD-L1 than the CD8+ T cells (see table 19 and FIGS. 11B and C). Treatment with anti-PD-L1 Ab, also resulted in an apparent decrease in the PD-L1 expression in all cell types. It is, however, possible that this decrease is due to partly blockage of the PD-L1 epitope by the anti-PD-L1 antibody used for treatment, so that the PD-L1 detection antibody in the surface labeling antibody mix is prevented from binding to PD-L1. Therefore what appears to be a PD-L1 down regulation by the anti-PD-L1 antibody used for treatment may be the result of epitope competition between the treatment antibody and the detection antibody.

TABLE 19

% of liver cell population with PD-L1 expression

|  | % of CD8+ T-cells | | % of CD4+ T-cells | | % of B-cells | |
| --- | --- | --- | --- | --- | --- | --- |
|  | Avg | Std | Avg | Std | Avg | Std |
| Vehicle (Group 10) | 35.5 | 4.7 | 0.75 | 0.52 | 5.9 | 1.5 |
| DNA vaccine (Group 11) | 36.8 | 7.7 | 0.61 | 0.08 | 5.5 | 1.1 |
| DNA vaccine + anti-PD-L1 Ab (Group 13) | 18.6 | 12.3 | 0.33 | 0.10 | 2.9 | 1.7 |
| Vehicle (Group 1) | 28.5 | 11.5 | 0.64 | 0.21 | 5.9 | 1.7 |
| DNA vaccine (Group 2) | 44.9 | 14.4 | 1.43 | 0.69 | 8.7 | 3.1 |
| DNA vaccine + PD-L1 ASO (Group 7) | 9.6 | 2.4 | 0.37 | 0.21 | 2.9 | 0.8 |
| DNA vaccine + GN-PD-L1 ASO Group 8) | 14.6 | 3.3 | 0.31 | 0.11 | 2.8 | 0.8 |

HBV Specific T Cell Response:

NK cells and CD4+ and CD8+ T cells producing pro-inflammatory cytokines were detected using the intracellular cytokine staining assays (see Materials and Methods section) detecting IFNγ and TNFα production.

In the spleen no NK cells and few CD4+ T cells secreting IFNγ- and TNFα were detectable (frequency<0.1%) at sacrifice. IFNγ-producing CD8+ T cells targeting the two HBV antigens were detected in mice treated with naked PD-L1 oligonucleotide or GalNAc PD-L1 oligonucleotide as well as in mice from this study which received only DNA vaccine (data not shown).

Figure 12:
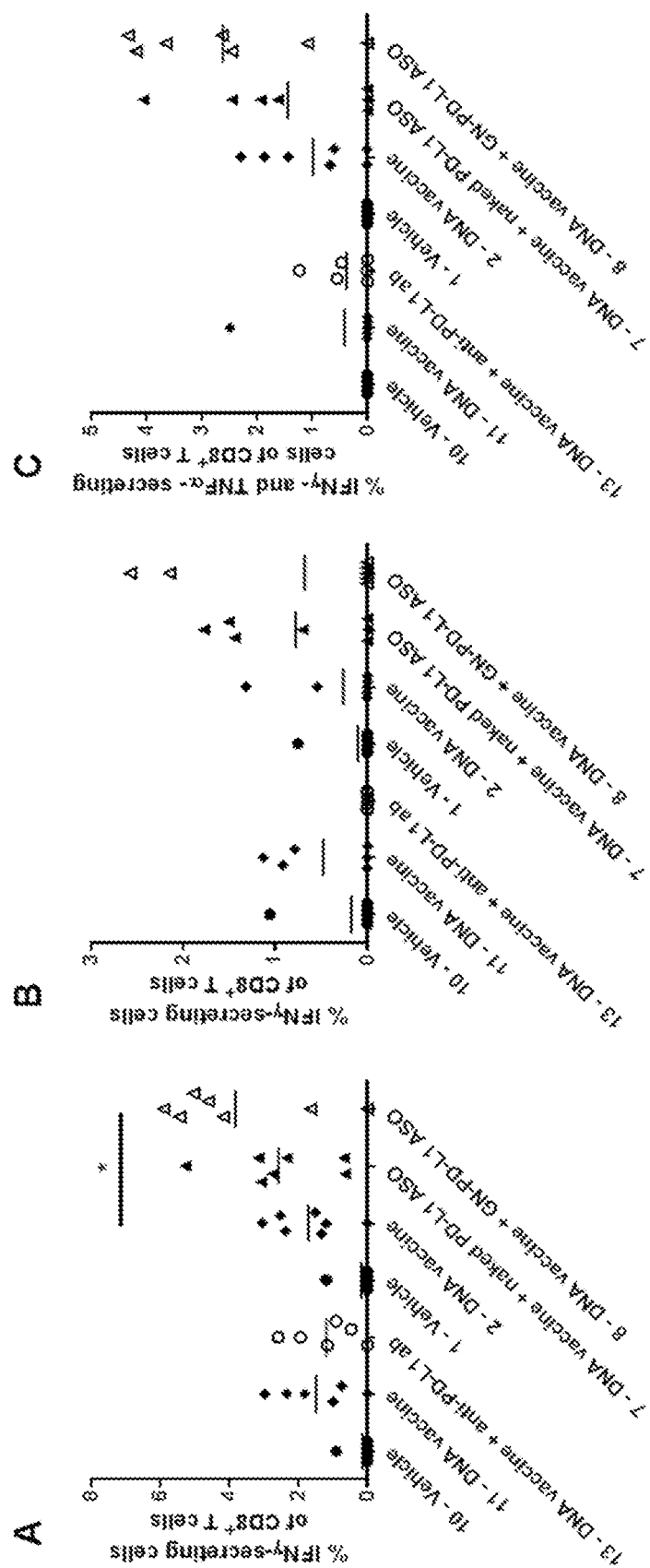
FIG. 12: HBV antigen specific CD8+ cytokine secreting cells in the liver after treatment with ● vehicle (group 10 and 1), ◆ DNA vaccine (group 11 and 2), ○ anti-PD-L1 antibody (group 12), ▲ naked PD-L1 ASO+DNA vaccine (group 7) or Δ GalNAc conjugated PD-L1 ASO+DNA vaccine (group 8), for each group the individual animals are represented and the average is indicated by the vertical line for each group (see table 20). Statistical significance between the DNA vaccine group and the three treatment groups has been assessed and if present it is indicated by * between the groups (*=P<0.05). A) represents the percentage of IFN-γ secreting CD8+ T cells in the liver which are specific towards HBV PreS2+S antigen following treatment. B) represents the percentage of IFN-γ secreting CD8+ T cells in the liver which are specific towards HBV core antigen following treatment and C) represents the percentage of IFN-γ and TNF-α secreting CD8+ T cells in the liver which are specific towards HBV PreS2+S antigen following treatment.

In the livers of DNA-immunized HBV-carrier mice, no IFNγ-producing NK cells were detected at sacrifice, whereas IFNγ-secreting CD4+ T cells specific for Core or for S2+S were detected in the liver of a few DNA-immunized mice at a low frequency (<0.4%, data not shown). HBV S2+S-specific CD8+ T cells producing IFNγ were detected in the majority of DNA-immunized mice. The frequency of IFNγ-secreting CD8+ T cells increased in mice treated with combination of DNA vaccine and naked PD-L1 oligonucleotide or GalNAc PD-L1 oligonucleotide, whereas treatment with anti-PD-L1 antibody did not add any apparent additional effect to the DNA vaccination (FIG. 12). IFNγ-producing CD8+ T cells targeting the envelope and core antigens were detected in most DNA-immunized groups (except anti-PD-L1 antibody) (FIG. 12B). Most of the S2-S specific T cells produced both IFNγ and TNFα (FIG. 12C). The results are also shown in Table 20.

TABLE 20

% of HBV antigen (S2-S or core) specific CD8+ T cells from total IFNγ or IFNγ + TNFα cell population

|  | PreS2-S specific T cells (% of IFNγ cells) | | Core specific T cells (% of IFNγ cells) | | S2-S specific T cells (% of IFNγ + TNFα) | |
| --- | --- | --- | --- | --- | --- | --- |
|  | Avg | Std | Avg | Std | Avg | Std |
| Vehicle (Group 10) | 0.15 | 0.37 | 0.18 | 0.43 | 0.00 | 0.00 |
| DNA vaccine (Group 11) | 1.48 | 1.10 | 0.47 | 0.53 | 0.42 | 1.02 |
| DNA vaccine + anti-PDL-1 Ab | 1.18 | 0.95 | 0 | 0 | 0.38 | 0.49 |
| Vehicle (Group 1) | 0.17 | 0.45 | 0.11 | 0.28 | 0.00 | 0.00 |
| DNA vaccine (Group 2) | 1.70 | 1.02 | 0.27 | 0.51 | 0.98 | 0.90 |

TABLE 20-continued

% of HBV antigen (S2-S or core) specific CD8+ T cells from total
IFNγ or IFNγ + TNFα cell population

|  | PreS2-S specific T cells (% of IFNγ cells) | | Core specific T cells (% of IFNγ cells) | | S2-S specific T cells (% of IFNγ + TNFα) | |
| --- | --- | --- | --- | --- | --- | --- |
|  | Avg | Std | Avg | Std | Avg | Std |
| DNA vaccine + PDL-1 ASO | 2.56 | 1.60 | 0.78 | 0.80 | 1.44 | 1.55 |
| DNA vaccine + GN-PDL-1 ASO | 3.83 | 2.18 | 0.68 | 1.16 | 2.62 | 1.62 |

Example 7—In Vivo Effect on HBV Antigen and HBV DNA in the Serum of AAV/HBV Mice In the present study AAV/HBV mice from Shanghai (see Materials and Methods section) were treated with the GalNAc conjugated PD-L1 antisense oligonucleotide CMP ID NO 759_2.

It was evaluated how the treatment affected the HBe and HBs antigens and HBV DNA levels in the serum compared to vehicle treated animals.

Figure 13:
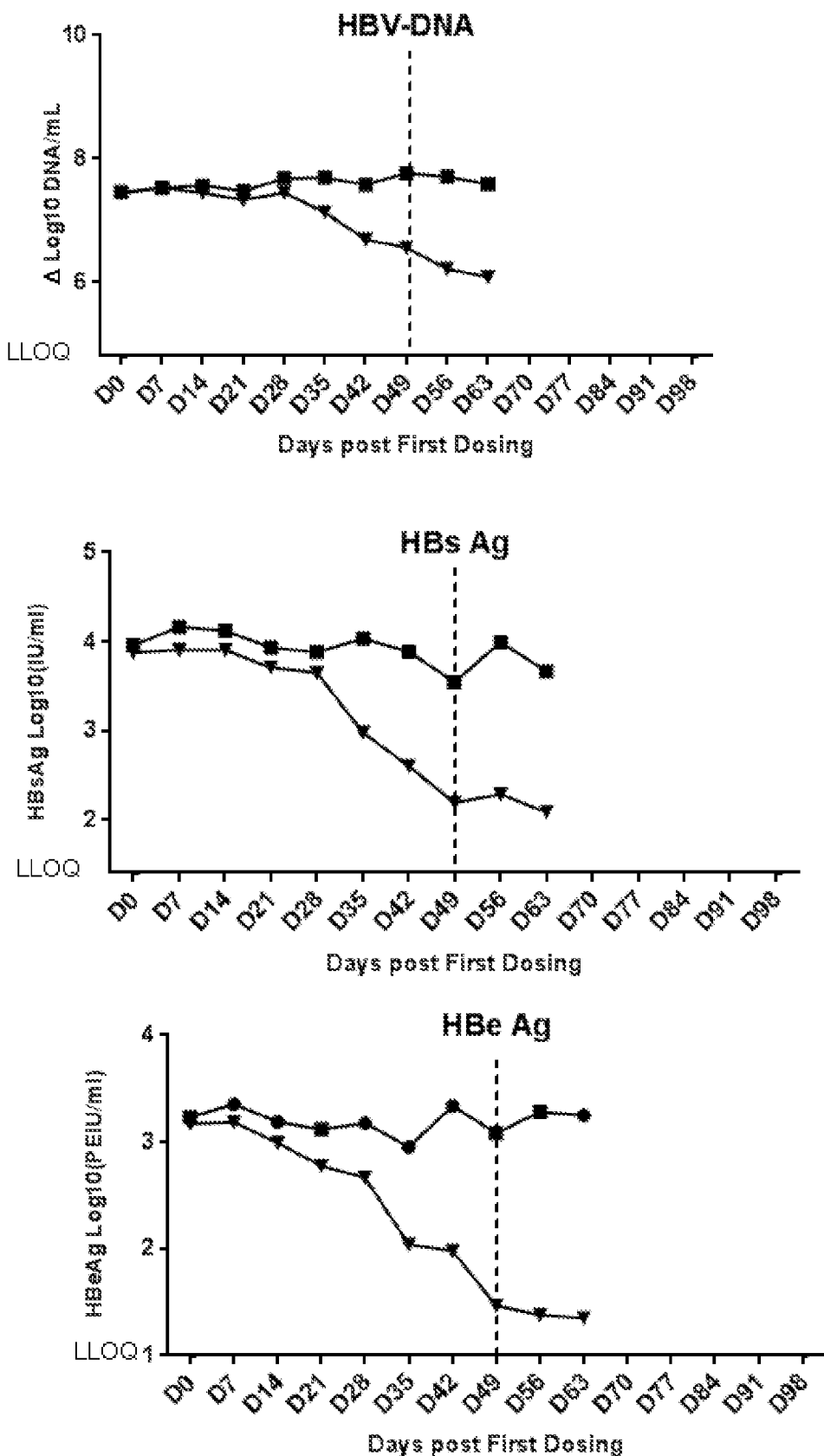
FIG. 13: HBV-DNA, HBsAg and HBeAg in AAV/HBV mice following treatment with GalNAc conjugated PD-L1 antisense CMP NO: 759_2 (▼) compared to vehicle (■) The vertical line indicates the end of treatment.

Treatment Protocol:

Male C57BL/6 mice infected with recombinant adeno-associated virus (AAV) carrying the HBV genome (AAV/HBV) as described under the Shanghai model in the materials and method section were used in this study. The mice (6 mice pr. group) were injected once a week for 8 weeks with the antisense oligonucleotide CMP ID NO: 759_2 at 5 mg/kg or vehicle (saline) both where administered as subcutaneous injections (s.c.). Blood samples were collected each week during treatment as well as 6 weeks post treatment. HBV DNA, HBsAg and HBeAg levels were measured in the serum samples as described below. The results for the first 10 weeks are shown in table 21 and in FIG. 13. The study was still ongoing at the time of filing the application therefore data for the remaining 4 weeks have not been obtained.

HBsAg and HBeAg Detection:

Serum HBsAg and HBeAg levels were determined in the serum of infected AAV-HBV mouse using the HBsAg chemoluminescence immunoassay (CLIA) and the HBeAg CLIA kit (Autobio diagnostics Co. Ltd., Zhengzhou, China, Cat. no. CL0310-2 and CL0312-2 respectively), according to the manufacturer's protocol. Briefly, 50 µl of serum was transferred to the respective antibody coated microtiter plate and 50 µl of enzyme conjugate reagent was added. The plate was incubated for 60 min on a shaker at room temperature before all wells were washed six times with washing buffer using an automatic washer. 25 µl of substrate A and then 25 µl of substrate B was added to each well. The plate was incubated for 10 min at RT before luminescence was measured using an Envision luminescence reader. HBsAg is given in the unit IU/ml; where 1 ng HBsAg=1.14 IU. HBeAg is given in the unit NCU/ml serum.

HBV DNA Extraction and qPCR:

Initially mice serum was diluted by a factor of 10 (1:10) with Phosphate buffered saline (PBS). DNA was extracted using the MagNA Pure 96 (Roche) robot. 50 µl of the diluted serum was mixed in a processing cartridge with 200 µl MagNA Pure 96 external lysis buffer (Roche, Cat. no. 06374913001) and incubated for 10 minutes. DNA was then extracted using the "MagNA Pure 96 DNA and Viral Nucleic Acid Small Volume Kit" (Roche, Cat. no. 06543588001) and the "Viral NA Plasma SV external lysis 2.0" protocol. DNA elution volume was 50 µl.

Quantification of extracted HBV DNA was performed using a Taqman qPCR machine (ViiA7, life technologies). Each DNA sample was tested in duplicate in the PCR. 5 µl of DNA sample was added to 15 µl of PCR mastermix containing 10 µl TaqMan Gene Expression Master Mix (Applied Biosystems, Cat. no. 4369016), 0.5 µl PrimeTime XL qPCR Primer/Probe (IDT) and 4.5 µl distilled water in a 384 well plate and the PCR was performed using the following settings: UDG Incubation (2 min, 50° C.), Enzyme Activation (10 min, 95° C.) and PCR (40 cycles with 15 sec, 95° for Denaturing and 1 min, 60° C. for annealing and extension). DNA copy numbers were calculated from $C_t$ values based on a HBV plasmid DNA standard curve by the ViiA7 software.

Sequences for TaqMan Primers and Probes (IDT):

```
Forward core primer (F3_core):
                                (SEQ ID NO: 784)
CTG TGC CTT GGG TGG CTT T Reverse primer (R3_core):
                                (SEQ ID NO: 785)
AAG GAA AGA AGT CAG AAG GCA AAA Taqman probe (P3_core):
                                (SEQ ID NO: 786)
56-FAM/AGC TCC AAA/ZEN/TTC TTT ATA AGG GTC GAT
GTC CAT G/3IABKFQ
```

TABLE 21

HBV-DNA, HBsAg and HBeAg levels in serum from AAV/HBV mice following
treatment with GalNAc conjugated PD-L1 antisense oligonucleotide.

| | Saline | | | | | | CMP ID NO: 759_2 at 5 mg/kg | | | | | |
| --- | --- | --- | --- | --- | --- | --- | --- | --- | --- | --- | --- | --- |
| | HBV-DNA | | HBsAg | | HBeAg | | HBV-DNA | | HBsAg | | HBeAg | |
| Day | Avg | Std | Avg | Std | Avg | Std | Avg | Std | Avg | Std | Avg | Std |
| 0 | 7.46 | 0.35 | 3.96 | 0.48 | 3.23 | 0.14 | 7.44 | 0.29 | 3.87 | 0.40 | 3.17 | 0.13 |
| 7 | 7.53 | 0.23 | 4.17 | 0.45 | 3.35 | 0.10 | 7.53 | 0.20 | 3.91 | 0.42 | 3.19 | 0.18 |
| 14 | 7.57 | 0.24 | 4.12 | 0.49 | 3.19 | 0.11 | 7.45 | 0.22 | 3.90 | 0.50 | 2.99 | 0.27 |
| 21 | 7.47 | 0.27 | 3.93 | 0.51 | 3.12 | 0.05 | 7.33 | 0.47 | 3.71 | 0.76 | 2.78 | 0.26 |
| 28 | 7.68 | 0.26 | 3.88 | 0.67 | 3.18 | 0.13 | 7.45 | 0.46 | 3.65 | 0.93 | 2.67 | 0.38 |
| 35 | 7.69 | 0.21 | 4.03 | 0.54 | 2.95 | 0.08 | 7.13 | 0.75 | 2.98 | 1.05 | 2.04 | 0.38 |
| 42 | 7.58 | 0.23 | 3.89 | 0.65 | 3.34 | 0.10 | 6.69 | 0.89 | 2.60 | 1.05 | 1.98 | 0.45 |

TABLE 21-continued

HBV-DNA, HBsAg and HBeAg levels in serum from AAV/HBV mice following treatment with GalNAc conjugated PD-L1 antisense oligonucleotide.

| | Saline | | | | | | CMP ID NO: 759_2 at 5 mg/kg | | | | | |
|---|---|---|---|---|---|---|---|---|---|---|---|---|
| | HBV-DNA | | HBsAg | | HBeAg | | HBV-DNA | | HBsAg | | HBeAg | |
| Day | Avg | Std | Avg | Std | Avg | Std | Avg | Std | Avg | Std | Avg | Std |
| 49 | 7.77 | 0.17 | 3.54 | 1.06 | 3.08 | 0.26 | 6.56 | 1.26 | 2.19 | 0.70 | 1.47 | 0.37 |
| 56 | 7.71 | 0.24 | 3.99 | 0.86 | 3.28 | 0.05 | 6.21 | 1.48 | 2.28 | 0.84 | 1.38 | 0.30 |
| 63 | 7.59 | 0.28 | 3.67 | 1.07 | 3.25 | 0.13 | 6.08 | 1.39 | 2.08 | 0.71 | 1.35 | 0.30 |

From this study it can be seen that GalNAc conjugated PD-L1 antisense oligonucleotide CMP NO 759_2 has a significant effect on the reduction of HBV-DNA, HBsAg and HBeAg levels in serum after 6 weeks of treatment, and effect that is sustained for at least 2 weeks after the treatment has ended.

Example 8—In Vitro PD-L1 Knock Down in Human Primary Hepatocytes Using GalNAc Conjugated PD-L1 Oligonucleotides The ability of GalNAc conjugated PD-L1 antisense oligonucleotide compounds to reduce the PD-L1 transcript in primary human hepatocytes was investigated using genomics.

Cell Culture

Cryopreserved human hepatocytes were suspended in WME supplemented with 10% fetal calf serum, penicillin (100 U/ml), streptomycin (0.1 mg/ml) and L-glutamine (0.292 mg/ml) at a density of approx. $5 \times 10^6$ cells/ml and seeded into collagen-coated 24-well plates (Becton Dickinson ΔG, Allschwil, Switzerland) at a density of $2 \times 10^5$ cells/well. Cells were pre-cultured for 4 h allowing for attachment to cell culture plates before start of treatment with oligonucleotides at a final concentration of 100 M. The oligonucleotides used are shown in table 21 and table 8, vehicle was PBS. Seeding medium was replaced by 315 µl of serum free WME (supplemented with penicillin (100 U/ml), streptomycin (0.1 mg/ml), L-glutamine (0.292 mg/ml)) and 35 µl of 1 mM oligonucleotide stock solutions in PBS were added to the cell culture and left on the cells for 24 hours or 66 hours.

Library Preparation

Transcript expression profiling was performed using Illumina Stranded mRNA chemistry on the Illumina sequencing platform with a sequencing strategy of 2×51 bp paired end reads and a minimum read depth of 30M per specimen (Q squared EA). Cells were lysed in the wells by adding 350 µl of Qiagen RLT buffer and were accessioned in a randomization scheme.

mRNA was purified using the Qiagen RNeasy Mini Kit. mRNA was quantitated and integrity was assessed using an Agilent Bioanalyzer. Upon initial quality assessment of the isolated RNA, it was observed that all samples met the input quality metric of 100 ng with RIN scores>7.0.

Sequencing libraries were generated for all samples using the Illumina TruSeq Stranded mRNA Library Preparation, starting with 100 ng of total RNA. Final cDNA libraries were analyzed for size distribution and using an Agilent Bioanalyzer (DNA 1000 kit), quantitated by qPCR (KAPA Library Quant Kit) and normalized to 2 nM in preparation for sequencing. The Standard Cluster Generation Kit v5 was used to bind the cDNA libraries to the flow cell surface and the cBot isothermally to amplify the attached cDNA constructs up to clonal clusters of ~1000 copies each. The DNA sequence was determined by sequencing-by-synthesis technology using the TruSeq SBS Kit.

Data Processing

Illumina paired-end sequencing reads of length 2×51 bp were mapped on the human reference genome hg19 using the GSNAP short read alignment program. SAM-format alignments were converted into sorted alignment BAM-format files using the SAMTOOLS program. Gene read counts were estimated for PD-L1 based on the exon annotation from NCBI RefSeq, specified by the corresponding GTF file for hg19. A normalization step accounting for the different library size of each sample was applied using the DESeq2 R package.

The reduction in PD-L1 transcript after incubation with GalNAc conjugated PD-L1 antisense oligonucleotide compounds are shown in table 22.

TABLE 22

PD-L1 transcript reduction in human primary hepatocytes following treatment with GalNAc conjugated oligonucleotides, n = 4

| Compound | PD-L1 expression level 24 h (library size adjusted counts) | PD-L1 expression level 66 h (library size adjusted counts) |
|---|---|---|
| Vehicle | 259 | 156 |
| | 159 | 168 |
| | 192 | 136 |
| | 202 | 211 |
| 767_2 | 7 | 7 |
| | 11 | 14 |
| | 22 | 9 |
| | 28 | 15 |
| 766_2 | 16 | 13 |
| | 15 | 10 |
| | 17 | 11 |
| | 29 | 13 |
| 769_2 | 15 | 21 |
| | 18 | 18 |
| | 25 | 18 |
| | 26 | 25 |
| 768_2 | 41 | 25 |
| | 27 | 48 |
| | 31 | 25 |
| | 34 | 22 |
| 770_2 | 21 | 16 |
| | 44 | 62 |
| | 67 | 51 |
| | 38 | 63 |

All five GalNAc conjugated antisense compounds showed significant PD-L1 transcript reduction after 24 and 66 hour incubation when compared to samples treated with vehicle.

Example 9—EC50 of Conjugated and Naked PD-L1 Antisense Oligonucleotides in HBV Infected ASGPR-HepaRG Cells The potency of two naked and the equivalent GalNAc conjugated PD-L1 antisense oligonucleotides were compared in HBV infected ASGPR-HepaRG cells.

Cell Line

HepaRG cells (Biopredic International, Saint-Gregoire, France) were cultured in Williams E medium (supplemented with 10% HepaRG growth supplement (Biopredic). From this cell line a HepaRG cell line stably overexpressing human ASGPR1 and ASGPR2 was generated using a lentiviral method. Proliferating HepaRG cells were transduced at MOI 300 with a lentivirus produced on demand by Sirion biotech (CLV-CMV-ASGPR1-T2a_ASGPR2-IRES-Puro) coding for Human ASGPR1 and 2 under the control of a CMV promoter and a puromycin resistance gene. Transduced cells were selected for 11 days with 1 µg/ml puromycin and then maintained in the same concentration of antibiotic to ensure stable expression of the transgenes. ASGPR1/2 overexpression was confirmed both at mRNA level by RT-qPCR (ASGPR1: 8560 fold vs non-transduced, ASGPR2: 2389 fold vs non transduced), and at protein level by flow cytometry analysis.

The cells were differentiated using 1.8% DMSO for at least 2 weeks before infection. HBV genotype D was derived from HepG2.2.15 cell culture supernatant and was concentrated using PEG precipitation. To evaluate activity of test compounds against HBV, differentiated ASGPR-HepaRG cells in 96 well plates were infected with HBV at an MOI of 20 to 30 for 20 h, before the cells were washed 4 times with PBS to remove the HBV inoculum.

Oligonucleotide Potency

The following oligonucleotides

| Naked PD-L1 ASO | Equivalent GalNAc conjugated PD-L1 ASO |
| --- | --- |
| CPM ID NO: 640_1 | CPM ID NO: 768_2 |
| CPM ID NO: 466_1 | CPM ID NO: 769_2 | were added to the HBV infected ASGPR-HepaRG cells on day 7 and day 10 post infection using serial dilutions from 25 µM to 0.4 nM (1:4 dilutions in PBS). Cells were harvested on day 13 post infection.

Total mRNA was extracted using the MagNA Pure 96 Cellular RNA Large Volume Kit on the MagNA Pure 96 System (Roche Diagnostics) according to the manufacturer's instructions. For gene expression analysis, RT-qPCR was performed as described in Example 5.

Data were analysed using the 2^-ddct method. ActinB was used as the endogenous control to calculate dct values. The PD-L1 expression is relative to the endogenous controls and to the saline vehicle.

EC50 calculations were performed in GraphPad Prism6 and is shown in table 23.

TABLE 23

EC50 in ASGPR-HepaRG HBV infected cells, n = 4.

| CMP ID NO | EC50 (µm) |
| --- | --- |
| 640_1 | 2.25 |
| 768_2 | 0.10 |
| 466_1 | 5.82 |
| 769_2 | 0.13 |

These data clearly shows that GalNAc conjugation of the PD-L1 antisense oligonucleotides improves the EC50 values significantly.

Example 10—Stimulation T Cell Function in PBMCs Derived from Chronic HBV Patients It was investigated whether naked PD-L1 antisense compounds could increase the T cells function of chronically infected HBV (CHB) patients after ex-vivo HBV antigen stimulation of the peripheral blood mononuclear cells (PBMCs).

Frozen PBMCs from three chronic HBV infected patients were thawed and seeded at a density of 200'000 cells/well in 100 µl medium (RPMI1640+GlutaMax+8% Human Serum+25 mM Hepes+1% PenStrep). The next day, cells were stimulated with 1 µM PepMix HBV Large Envelope Protein or 1 µM PepMix HBV Core Protein (see table 9) with or without 5 UM of CMP ID NO: 466_1 or CMP ID NO: 640_1 in 100 µl medium containing 100 pg/ml IL-12 and 5 ng/ml IL-7 (Concanavalin stimulation was only applied at day 8). Four days later PD-L1 antisense oligonucleotide treatment was renewed with medium containing 50 IU IL-2. At day 8 after the first stimulation the cells were re-stimulated with PepMix or 5 µg/ml Concanavalin A plus PD-L1 antisense oligonucleotide for 24 h. For the last 5 h of the stimulation, 0.1 µl Brefeldin A, 0.1 µl Monensin and 3 µl anti-human CD-107 (APC) were added.

After 24 h the cells were washed with Stain Buffer (PBS+1% BSA+0.09% Sodium Azide+EDTA) and surface staining was applied for 30 min at 4° C. [anti-human CD3 (BV 605), anti-human CD4 (FITC), anti-human CD8 (BV711), anti-human PDL1 (BV421), anti-human PD1 (PerCP-Cy5.5) and Live and Dead stain (BV510) (BD Biosciences)]. Cells were fixed in BD Fixation Buffer for 15 min at 4° C. The next morning, cells were permeabilized with BD Perm/Wash Buffer for 15 min at 4° C. and intracellular staining was done for 30 min at 4° C. [anti-human INFγ (PE)]. After washing in Perm/Wash Buffer cells were dissolved in 250 µl stain buffer. FACS measurement was performed on a BD Fortessa (BD Biosciences). For the analysis, the whole cell population was first gated on live cells (Live and Death stain, BV510), and then on CD3+ (BV605) cells. The CD3+ cells were then graphed as CD107a+ (APC) vs IFNγ+ (PE).

The results are shown in table 24.

TABLE 24

Effect of PD-L1 ASO treatment on CD3+ T cell from PBMCs isolated from three chronically HBV infected patients.

| | No antigen stimulation | | | Envelope antigen | | | Core antigen | | |
|---|---|---|---|---|---|---|---|---|---|
| | Saline | CMP 466_1 | CMP 640_1 | Saline | CMP 466_1 | CMP 640_1 | Saline | CMP 466_1 | CMP 640_1 |
| INFγ-/ CD107+ | 1.16 | 4.95 | 4.81 | 4.7 | 9.12 | 8.62 | 3.84 | 9.66 | 7.31 |
| | 2.7 | 3.59 | 2.74 | 2.57 | 3.69 | 3.2 | 3.25 | 3.34 | 2.92 |
| | 3 | 3.87 | 3.98 | 4.59 | 12.5 | 10.9 | 9.23 | 6.11 | 6.88 |
| INFγ+/ CD107+ | 0.12 | 1.03 | 1.15 | 3.19 | 17.3 | 18.9 | 2.38 | 15.1 | 5.75 |
| | 0.49 | 3.12 | 1.75 | 2.73 | 7 | 5.34 | 1.63 | 2.35 | 1.9 |
| | 0.24 | 1.13 | 1.5 | 1.6 | 8.16 | 3.06 | 1.68 | 1.9 | 1.91 |
| INFγ+/ CD107- | 0.33 | 1.43 | 1.08 | 5.11 | 7.74 | 9.47 | 3.14 | 7.76 | 2.83 |
| | 0.61 | 2.9 | 2.26 | 7.84 | 5.79 | 5.78 | 2.33 | 2.82 | 2.95 |
| | 0.17 | 1.57 | 1.72 | 1.22 | 2.58 | 0.99 | 0.1 | 0.61 | 1.04 |

From these data it can be seen that the antigen stimulation by itself is capable of inducing T cell activation (increase % of CD3+ cells expressing INFγ and/or CD107a) in the PBMCs of CHB patients (n=3). The addition of PD-L1 antisense oligonucleotide CMP 466_1 or 640_1 resulted in an additional increase of CD3+ T cell response. This increase was mainly observed in the HBV envelop stimulated group

SEQUENCE LISTING (1562 sequences)

SEQ ID NO: 1 - DNA, 20064 bp, Homo sapiens
  source 1..20064: mol_type = genomic DNA
ggcgcaacgctgagcagctggcgcgtcccgcgcggccccagttctgcgcagcttcccgaggctccgcaccagccgcgcttctgtccgcctgcaggtagggagcgttgttcctccgcgggtgcccacggcccagtatctctggctagctcgctgggcactttaggacggagggtctctacaccctttctttgggatggagagaggagaagggaaagggaacgcgatggtctagggggcagtagagccaattacctgttggggttaataagaacaggcaatgcatctggccttcctccaggcgcgattcagttttgctctaaaaataatttatacctctaaaaataaataagataggtagtataggataggtagtcattcttatgcgactgtgtgttcagaatatagctctgatgctaggctggaggtctggacacgggtccaagtccaccgccagctgcttgctagtaacatgacttgtgtaagttatcccagctgcagcatctaagtaagtctcttcctgcgctaagcaggtccaggatccctgaacggaatttatttgctctgtccattctgagaacccaaaggagtcctaaaagaggaatggaggagcctaagaataaaaatagtataataaaacatttcttagacacattgaccttggcctatgtcaaagttcagtctgggtttgtcttataacacaaggagtaaaagtaccattgttctacctctttttttaatacttgaaaaaaatttactgtggatgcttttctatgaattaaataaccttctaaaaaatgttttcattgctgcattcgattagattgggtaactaaatgaaattaattcctcactgttgggtataaaggttatttacagtggttctgtcttagccattcactgaactcattgcatatatatctctggaatattgctgattgtttccttcaagtaaacttagaagtgtaactacttagtcaaagagcctgaatattttaaaggccttttgaagaaaactgaaaatgctttccagaaaggatgtatcagttgacaatgacagtcgtcaacagtatttaaggagaactatgatactctgaagaaaaacttagcctttctcagtaaaagtaggtaggcagaggccacatgacagcagttagagtgtggtcttcaaggaagtcacagaaatactgtggggaattgaaaccccatgtggaaaatgtacaagagtgtctcagtgtgactgagaaggaggttgggcatggggtttcatggagtttaataaagtttggtcacttagtagaggtttaataaatcaactgtcttaatctttgatcctacttaagaattttttttttgtttttgtagagatggggctcttgttatgttgcccaggctgttctcgaactcctagcctcaggcgatcctccctcctcaggctccagaagtcctgggattactggcgggagccaccatgcaggcctcttgctcctacttttgagaaaggaagtttaaccggttttttttgtctttttttttttttttttgagacagagtctcactctgttgcccatgctggagtgcagtggtgcaatctcagctcactgcctcccgggttcaagtgattctcctgcctcagcctcccgagtagctgggactacaggcacctgccaccacgcccagctaatttttgtatttttagtagaaatggggtttcaccatattggccaggctgatctcgaactcctgacctcaggtgatccgcctgcctcggcctcccaaagtgctgggattacaggcatgagccactgctcctggctgcttaactttttctctatctcatcctcctacccatcctacccttggaagatagagaagtagtattagttccatagtgttatactgggcttcccccagggacaaacccacttccccaacctgaatgagccatcacttcttccccagtttacatttcattgctctttaaatgtctccattcggatatgggaattcacatatggtcataattcttacctgaagaagatgtcagtcttcttctcttagaccaactgccctgatatgaggtttagaggttaaagaacatgtgtgtatttacatgatctttgtattctgccttttcgtccctcactaatgacagctgcaccccaaggaaatggagctgtggaagagagggtttgataagaaattaagtaaatattggatctaatccatcaccctccaggaagcctttattactcctaaaaatttcaaccaaattcattaaaggacaagaactccaccagagtaggccataaacattggcaaaattagttgtaatccatgactagatttaatgtccctttgttttattcccatatggttataatgctttgcttggcattaggggtattttaagttttcttctgcctagtaagtgaatttgtgtttataatacaataatcataaaatatcacattaatattttataactgtacagttataaaatattttataagtaatatttatattttataagtaatattttataactgtacagttaactctggcccaaggaaaagatagtctgatagatgctgcagccccattttagcaaatgtgacctcacaggcctgaatgccatcgctattccacatctacaggatagacggaaaggaaagaaataaaaaaataggtacctaacactggcaagaggatgatgactcatgttatttcacttaacctttttatcttttaacatgaaggactcatacaggttgataagaaaccagtgacataaacagaccaaaaaatgatcagatctttcaaattagcaaaaaaataatattttttaaacaatgggtgaaaatacagtgtaacagtaccaattatcaacatgtgttgagaaccagaaaaatgttctttttctttgatcagcaacactatttgggaaaatctatcctcagggcctagcctggggccctggcacacagtaggcactcaacgaatatttgctgaacacacaaatacttatgatattttaaaaaattggcaacaatctgatacctaacaatagagggattaaatattatggaactgttaaataagatgcttatgaataccatgcagtaagatgggcaatatttatgccataagctttaatgaaacaaatgggtattaaatgtatgataaggttataaattactttttaaaagattacagggaaaaaaattgaaagatatacactgaaatgttttttgctcacagtggtgacaaggtttctcagcactggcactgttgacgttttaggctgtatgtctttgctgtgggaggctggcctgtgcactgcagggtgtttggcagcactcttggcctctgcccctagatagcaatagcagtcctccctcaaccagcccaattttgacaaccaaaaatgtttccaggcatcaccagatgctccctgggtgagagtgatgaaatagtaggggattttccccttcttttcttattttctgtaattccattatattactttaataataaagaaaaaaacataaaaaataaacgaatgttattattctacgtcagtttggatgtttggactccattttggggttctttccattatatcacttggtctgctaaacattctacggtttggtaaggtgaagtgattcatgaaattttggttttatttttttcctgatactaaaaataaaacattctttcacttggaaatttggacacagaacaccaaaaaaaatccataatctcatctctctttttctgtcttttccttccttttttccctttaaaaacaataaagagtgaaacctacctgttctccctctaatttaattcctaaatataatcactgtcaatatcttggacatttcctgtgtctaaacacacacacacacttttttttttcagcaaaagtggatttctgctacatgtagtgttctgcaacttactttctatgtgtttacaaaatcagtacatgtacatatgctgaattcagtccttaatggtattatattttgtgaatataccaaaatttgtttaaccacttagacaatctaggatattctcagtttgctgttatgagcaatgctcttcctttacatatacagacatatatatatatatgtgtgtgtgtgtgtttttgttttagtaggatagatttctaggagagggtgaaaggtcttatgacatccgcatttacgattgtaataggaagtatcaaagtgccccctaaagaaaaaaatcctcccattagtgggtaagaaagcctatttgttcatatcttcacaaacactaaatattagaaatatttacaattgtggtcaagctcataagtgaaaatggtatttcatatcttatattttttattgtgagattgaacatctttcatatgtttacatgtcacctgtatttcttattctctgaactatatgttatgacctttcactttttttcctcatgggttatgtgtagtttgtatagttgtcttattgattgttaggagctatttatatattaggaacattaatctcctgtcttatatatacgtggcatcgattagttgatcatttgtgagttcatgtctgtatacaaagattggagaggcactaagagggaaaacttacctctttcttatcaaagtttgtaaatatatgtataacagaagagggagaaaatattaataaatgcacagattggctgaaatagagtataaatcttttactcccctacttcaacataaactgcaaaaggagagtgacttttctttcactctgacttccgtattcctcatgcttaaaatagtgcctagcacagaagaggtgctcaatcagtgtttgctaaacgaaataattagtcacatttcaagcaggatgactaaatgaagaatagaatctaggcagatactctggaagagtggctgtgagtcattcatatcttagtatgaattagtcaaatccaactctctccccttcccactccccactgttagtagaagaatctgtttattgagagaatagatttataatttagaataagtgagaggggcagaagaggagattttgaaggatggcacctgaaggaggactagcatggctgagacagtgaagtggaagccttgaatagctaaagggtaagatgaaagtatttagctgtagggggaaaaagcattgacaggttggaaaagtaaaagtcagattctccttgctctgaaattttgtacagggcaggttctactaggtatgttacaatgcagaaaaaacatgaaataattgagaggaatttggtgcaatattatcttcttggcttcttttgagtgggcagatttttttcacggcctgtaactataataaatttgaaacttctcatcttttagtaacttttttcacttaagtttatgtggctgtgggcaatggaatgaagatattgaacttccaattccctgttgggtttccacaattacaagtcaatcatgactggttattagaagactatttcagttagaaccaccaagtcccatattgtcatattgtatgtttaattattaagtgaagcagtcttcttttcgtgttttccataattagggcattccagaaagatgaggatatttgctgtctttatattcatgacctactggcatttgctgaacggtaagacaccaaatccttccattaggttctatattttaaatattttaaccatgagtttaaaactaaaatgatcatttaaaatgcatgcaattttcttatagagagaacattctattctttcttctactttacacaatggcaaagtcttctttctactttacgcaatgataaagttacctgtgtcattttgtaaaaatatagagaatatagacaaattgaaagacacaaaataatctattacccatttcccagggttaactactgaaaatatctggggaaatggcctgtatgtatacatttatttgtttgctttcaacaaggccaagatcctttgatctttcagtcttggttgctctgtgacatgcctttcctgatgaggatactttaaggaagaattgtaagatacatggaaaatgtcaggctaacacagtactggcatcaccctgtgctctttcctgaactccataccaatgtacttcttgccagaaaactgatcaaaagtttagggaagtaaaaagagatgactgttagaatctaccattccctctatgtaggaagcaaataggtgtcctgtcaaaggacattctggggatgtctacatgaaaccaagtctccctggttgtaaggactccatctccatataatatttatacagtaatatatgtttataaattgtgggggcaacttgtttagctaattttattattctgctattgggacactgtgtctcagcatgagatatagtgtcccaaaacatatttcaagcccattggataaaatatgtgtttagcaagttcttaaatataatgataacataaccgaccagataaagtgatttataaacgctgtgccaattttgtaaatgtttcgaggaattttcccttttctgaagattgtccttctttctttttagcatttactgtcacggttcccaaggacctatatgtggtagagtatggtagcaatatgacaattgaatgcaaattcccagtagaaaaacaattagacctggctgcactaattgtctattgggaaatggaggataagaacattattcaatttgtgcatggagaggaagacctgaaggttcagcatagtagctacagacagagggcccggctgttgaaggaccagctctccctgggaaatgctgcacttcagatcacagatgtgaaattgcaggatgcaggggtgtaccgctgcatgatcagctatggtggtgccgactacaagcgaattactgtgaaagtcaatggtaagaattattatagatgagaggcctgatctttattgaaaacatattccaagtgttgaagacttttcattcttgtaagtccatacttattttcaaacagaacagcatagtctgttcattcattcattcaattcatgaattcattcacataattatccaatttcttgagcacctatttgatagtcactggaaatccagagacaaacaacacagagccatgttctacagtatgtacagttttccaaaaagaatttctagtctttacttttttattacaaatggaatacgtatacttgcaaataattcagatactgtggaagagatcaaatgaattgcaaaagtgtccctcctcccttcaccactatctcccatggcatgcagagagagtaaccattatttgtgtgtccctccagaaatttttttattcaactactatttttttattttattaggtccgtcagttttccttttttgagcctctctatatcaaatgcaaataaatatattcagaacaaaccccactgtaaggttcacattaaaaaagacttgaagtcaccctatgaagacaaaaaataatcacattaagtgtgaaagaacctattcttccagtacaggataagccatacttactgggcatatattcatcttgaaaatctatactgatgttgtcttggggaattgaaaaggaactaggagtgttagttcctcggtattgacccacagttatgttatcaggtcacttgagttcaaagttttgtgttggcactagctaagtaaaggaaaacacctctgctttcattgttgagtttcacagaattgagagctgaaaggatcccaggcaggagcagctaatccaaactcccacaaagaacaaaaatcccccagaggatcttctgttcttatatttcctgcaatggcgtccctgtcatatcccacaatggcctccctgccatttggatatcccttccatatcctgttgaaattactccctaatagtaagctgaaatctgcccctctagttgtagtcttgggattatttcatttacatgatgaccttttaatatttgactagaattaaatcatctccccttggtctttccattcctgggctaactaccatcaatctgagggctaacaatacaagtagaaaaagtatacatttgtcactgatcactgatcaattattaatcaatgatcactgataactataaactcaaaaacaaaatcatgtggggattaagagaaatgtatcagttttatgttgtatttctggtccctgatactggctcaggtaatgccactattgtcaagaagataccacttgtaaagtagatttaattttcattatattttaccatatgcttctccattcatgacatctcttgagatgttgtggtttatactttcagtttttctccagtccatccgcaaatatcaggcatctactgtgttccaagatattaaagaaatcatcatgacttagcctcatcaacagcattgctagatctgggatggaaaggaagagtataatcctggcagtcaggaagaaggcagcataaagtataagtttctgcttccaaaaaaggtctctcatcagcctgtagggagtgtgtagggaagggacagctgtccttgtagtagggaagggttttattcaggtcgtctgggctccataatatcccttgtgtatctgcagtctcctttgccatggatcaacacaataggaaatcttccggcactgatggtttttccaagggggagttcttcctggagcaaagcaaatgaccaaccaggtttgaggacctgatttgtttgacaattccattttgtattgtaaattacttaattggcattctactcccaatccatcttgtcatttgcatacagtggttttgggattgagttcagctataccaaaagtctgaaccttctgcacttagaacaaggcaaccaccaagcttcacttgcactgaggccgtgtctccaatggaaatgaggcagctggcttgcaggagcttcccaactcagggaagtagaactcctgagtcacctccatatgcaaatgatttcacagtaatgctgttgaacttcacttcccatcacagcaaatgtgtggtaacatagcttccccacaggagtttactcaccatggtattttaaaggtgaaacatttcaaaactgaaatttgaaagaatttagttttggattcactcaattatcactatcacttcgggtgttattgcacctttcttgtttgtgagtttaaatgccagactctcaggccactaactttcaattaaaagtgtttttctttaatcgctgaacctaacagcagggaaaacgaaatgttcattcagactttcagaaccttcaatgagattaggcagctgaaagatcaaagtgttgcatagttgtcccgataaagctatttggatcatatggaccaaatcgactgctgtcattccccaccaaccccatctctccccaaaattcccagccctgtttaagtgttctctgtagcatttatctctatctagtatattgtgtagcatatcatatcatacttttctgttttgtttattgtctctctcctcctagaatataaactccacaagcacaaagatttgggcctgttttataatattgttgcatccccagggcctgatatacagcagagtggtggtacgaaaagagcacacaaaaaaatatttgttgagtcaatgaatgaatgatttcctcaaataggattagcctaaaattttggaaacatgaacagatttggatatgtgaaaatttatttccagactgttcatcaggaactgttagcagcttctaaagggtacactggagcagcagtagtaaaaggaggaagaggagcagctctgctactgctactatcgagtactactacaattagcacttgcttattctgtgtgttaggccctgtactgaacactctgtctaaattagttcatttcctcctggaaatgactctagggggtaagtgcttcatcatgtaagatgagtatttttcacattttgttgtgtctgaaatctgagtgtgtctttcaatgatggaatctttgattccatgataagtggtattattcccattttaaggatgaggaaactgaggtccaaagaaattaagtaatttgcccaaattcacccagcctagaaaatgataaagctagttctaaacccaagcagattagctctgaagtctgggcccttaataaccactttttattgcctatatttgtacctctggtgtacgtatcaagttatatgttgacttcaaaactatcatgaccttttcttggttttgattgtccaacattagtatagtgttctgggtctgcaaaaattttgattactcatctcatctgtaaaacattttgaactcgtgtgtttgtgcatgcacatttgtgtgtaattataaaaattttactttctgttaatatataagttgtatcataagaaactgccgtttttgaagagcaaaaaaaggttgaatgttaccagttacatctggttcaacctaatagacatttgtacaaaaacagacattttaagaggttgaaataaaaatttaataaacaatattttcagtttttactaattgtgatgcttcactatcattagctaatatgtcaaggcataatataccttagggtgaactttatcattaacaaaggtggatggtgtcaataatcttgaggtttgtgtttttttatataacactgcgaggtctaattaagtacttactgtttaccacctcatacagtggccgataaaaagtgtcacttctgctgtttcctctgggttgtgcttgaattattagtattatcttcagtcctcagtttctttgtgggaaactttttaattagttgtttaattttgtaagatggttagtttagtcaaaattagataagagaatttgaaaatccgtagctaccccaaagcaacctacacataagaactattatttttgtgttttgaaatcataattttattgatttccagtgtttccactggtagtggtttcattgatataggagtatcaaaacatcactcattatttatttcagtttcatttgatcctagccgttttgtattaactctctgtgaagaaattacctcacaaatctattgctgtccttggtaaaggaatggagaattaaggctctagatcattagtggttacactatagtattagaagtaaaaaaaagattataccaacaaaataagaacatgttaatgtacttgtaatgaataaacatgaataaagctcttatgctatataggtgcactaaacaatctactagaattgtcagcaaactacgtatcttaatcctgaaagggtcccaaaccaatgatctaaaattgaatcaaactttcttccttgagcataattacttaaatgatttattaaaatagccagcatttaaaagcttaaaatgtaaatatcataatgtggtatcctagatagcatcccagaacagaaaaaggatattagggaaaaactggaggaatggaataaattatgcagtttagttattaataatgtactaacgtccttagttatgacgattgtaccatggtaatgtaagatactaacaatagaggaaaccgggtaaggagtatacagtaactctatactatctttgcaacttttttgtaaatttaaaacttctaaaataaagaacaaatttaaacattaaaaagtatcaccaggaacatatatcactgtttacagatgaaatactatgtattttcatatctaatttctgatcattgacttcaaatcagaaaagtgaatgacacctcaaaatcaggttttctgtttactgaagtctaagaaaagaaagcataccagctggagagattcatgtttataaagacagatttataacaacaaaaataaaatatccaagaataaatttaagaagaagcactttactgagaaacatatgaaaacctgaacaaatggagagggatattttgtatttgaatagaaagacttctggtttaaagataattctctttaaattattttttgtagaaatttaaggggtacaagagcagtgttgtcacatggatatattacatagtggtgaagtctggggttttagtgtaaattaatctttacattttgtttgagcccaataaatgtaccaacatgatttttatagaaagatagtcattcctattaatccaaacttgtcccaactttgaattgaattgaggcagagctagcaggtgttccccacggctgaggcatctgaacattaagcatatccctctgagaaccagcctgcattgatactctttctaatgtggacagcatcaagctatgtacgtagttctgtgctcagcaaaagccctgacttctttttgtttatgtcctagccccatacaacaaaatcaaccaaagaattttggttgtggatccagtcacctctgaacatgaactgacatgtcaggctgagggctaccccaaggccgaagtcatctggacaagcagtgaccatcaagtcctgagtggtaagaccaccaccaccaattccaagagagaggagaagcttttcaatgtgaccagcacactgagaatcaacacaacaactaatgagattttctactgcacttttaggagattagatcctgaggaaaaccatacagctgaattggtcatcccaggtaatattctgaatgtgtccattaaaatatgtctaacactgtcccctagcacctagcatgatgtctgcctatcatagtcattcagtgattgttgaataaatgaatgaatgaataacactatgtttacaaaatatatcctaattcctcacctccattcatccaaaccatattgttacttaataaacattcagcagatatttatggaatataccttttgttccatgcattgtagtactcattggatacacatagaataataagactcagttcacactcttcaggaaacagataaaaaactaagaaacaaacaaaaaacaggcaatccaacaccatgtgggaaatgctttcatagccgggaaacctggggaatacctgagaggaatactcaattcaggccttgtttcaggaatccaaatcctggcacatcagagctgcttccctctttccagggtggcaggaaataaatggaacatatttttctatcttatgccaaacatgagggaccctttctccccggtgcctctcccaaggtagtctacaatatttcaactctagcagtctgcttagtgcatagaacatgaggctgtgtgtccctgggcaaattactagacttctgtgtgcttcactttccctgtaggattataatctactgagcaagcttattgtaagggtcagattagcaacagtgtatgaaaatgatttgagaccattgcctgcacaaattcaactatttttttttatctcactactctacagaagtaggtagggtgggagacagagtctgatgagaggctcagaatgtgaaagaaagtgaggcgagtgagcatgatatttaatataaacacaaagatattctgagaagagctgctcactgccccctcccccaatacatgttgataggaaaatgccacgtacttcagcaaaaacaactgaaaaattagatagaaaagtcaatcaataggaaaagataatccaggacggtgttgtgaacagaaagagggggaaaaaactttagaaaatgatggggatgctcttactggggtacgagtcctcaggtattgaactggctttcagtaaaagctagattagtgggttcctgccatttacaagctgttttatgacaacttacttgttgggtggcctacagtaactcacctaactgcactgagtctgtttcctcatctgtaaattggggatttttttttaaatacctggcatgcctaactcataaagttgttctgaaactgaaataaaacatacgtgaacaggcattgtaaactgtaagttacggaaaaagctggctgttgttgtgtctttaaagtttcacctgggtagtcaaagatggatcatgggtctcagtggagagctgagccaggcaggagctgactaagggtgagaggtgggagttagcagcctctgaacatctgtgtaccatgggaccccctttcctcctgcatggtaccccagacaaggagcctagtaagagatactaatggcttgttgtccagagatgttcaaactgcagagaaagataagacaacaagcattggcctccaatcatgatgacagataggaggaggtgggagctccttagcagtgctggttggccttccatgttctactgtgggccatctctgccatgtactgtaggctactagcttctatattaaagaatgcaagaggggccaggagcggaggctcatgcctgtaatctcagcactttgggaggccaaggtgggcagatcacttgaggtcaggagtttgtgaccagcctggccaacatggtgaaactctgcctttactaaaaatataaaaattagctgggtgtggtggtgtgcacctgtaatcccagctactcgggagactgaggcacaagaattgcttgaacctgggaggcggaagttgcagtgagcccagattgcgccactgcactccaccctgggcaacagagaaagactctgcctcaaaaaaaaaaaaaaaaagcaagaggaagtgaaataatcaaggccgccatttaatagtgagcagccactccatgtggtactgtgcaagcacattataaatattagcctcacaagaaatgtattagcatttgtattttgtacactggttaagtatcttgcccaagacctcaaaactggttaagggcagcagaatttagccccagcaccaccttttcaaagcctgggcttctcacacttctccatgctgttcccattttaacacaggtatctcgccattccagccactcaaactttggcatttaagaaaattatcctaaagctaaactaaacttcaaggatgaccattctcctgaccccttcccatcaaaattttatctttagtcagtttgttttcgttttgttttgtttttcagaactacctctggcacatcctccaaatgaaaggactcacttggtaattctgggagccatcttattatgccttggtgtagcactgacattcatcttccgtttaagaaaaggtagtatttccttaattgcagtggtctccactgggggtgaggaaggggtgagaattggatcatggctgcaaggaaacccgacttaacctctgcaaggtggtgcaaaggcattccactgttcaacagcaattatattgaagctgagtgggatcactgggtgaagatgaagcgtaaggggtgaggggcaggagaatgggtatggatggaggtagaagatgcagtgtcatacagtttttttctatcatgaaaataaccacagacttacagaagagaaagagctaaaatgcccgtcattttcagttgcattttagtcttgcattagttgcaaccagctggtttctgggtaccctaagtaataaaaatagttcctctgtagaactgtagtatgtttaccatagagtattttgcaaaatttttggtagaggatgttacataatttgcatgtgttcatttctccatttacctgtgggaacaattaaaatccaggaaaatgagtatattcaaataatttcctcccatttaagatgagtcagagtaaataattcctccaatacttagagaagtataccaagagatccagtgatggtatagagttgtctgatgttaaatagggaagtagaatatggaaggggattccaatagtcgttgaaaaattccccataaccccttacatgggggaaagtagtgttaactgagagagtagagataagctgtttccaaaaattatattcttaacaggactgagatagccagaatataaggatcaagtttcaatgacagtaagatcctgagatggagttgatttgcacaaagaaataattgttgccagcatgcattttgaatatttctctggaaaaaaagattagttggcagtagaaatggatagaaatcaatagatattaaaatacctcagaatttggttcatctctgggaaaagatgaaaaataaaagtgtatactcctcaagaacatctaggatcaaaagcatgtgccctacactattgaattaattaacctcataagttgggacctgtggaataaggatgtccaccagacttcctagggattacaaatgtttcacagaacttgaaatttaaacttgggtcactgtatgggatgtagagctgtgctatatggaaataaaaatgatttctttttctcaagggagaatgatggatgtgaaaaaatgtggcatccaagatacaaactcaaagaagcaaagtggtaagaatatcagaaggaattgggaagtaaaagtcaaaggaaacaaaaagctaaagcaataacaaagagaaatccatcagtcataatctcctctccttttaaagaatgctggttcccctttgcctcacagctaacacaagaactcctccaccgtctgaggaggtttaggagcagggaaggggaaggagtcagcttcatttgctaatcttctgttgccctgcaccctagcagctccttgcagcaggggacaaggatgacttaggtggatggataattaattgattctaaaatattgtgtgtcagtattgtaatactatgttaattgcaccatgcacggtatctcatttaatcccccaccccttgccattaccaaagagagagagagagagagagagagaaatactagaatttatcctcattttacagtagagaaaacagagggtcaagaagataatgtaaagtgcccaagaacacacagctgatcacaaaaatcaagcttgggggccattagcctaaccacagacccttactcttaacccatctgcttcaatccattttgctacaaatgtttacatttataagcagggcagaaaaacctcatccaggttattgaactaagaagaaagttatattaaggtttctaatttttttaatgtagttagaaaccaaacttaacaatgagcccaagtttaaagcagtctaattaacctggacaagctcaggcaagtttcattctgtggcccatagcatcatctgtgttgtaaagctaagtagcaaatgttgtttgggtcatgctgggggacaagccatcccaatttgctcaggactgaggggttttccaggatatcatgtaaggataattgggtacaaatataacctgctgctttctctcatttcaaatttatcatttatcatatcagcaactatgagttatgttttttattagatttcttgttactttttccccagaccacttcccatgaaattaatatactattatcactctccagatacacatttggaggagacgtaatccagcattggaacttctgatcttcaagcagggattctcaacctgtggtttaggggttcatcggggctgagcgtgacaagaggaaggaatgggcccgtgggatgcaggcaatgtgggacttaaaaggcccaagcactgaaaatggaacctggcgaaagcagaggaggagaatgaagaaagatggagtcaaacagggagcctggagggagaccttgatactttcaaatgcctgaggggctcatcgacgcctgtgacagggagaaaggatacttctgaacaaggagcctccaagcaaatcatccattgctcatcctaggaagacgggttgagaatccctaatttgagggtcagttcctgcagaagtgccctttgcctccactcaatgcctcaatttgttttctgcatgactgagagtctcagtgttggaacgggacagtatttatgtatgagtttttcctatttattttgagtctgtgaggtcttcttgtcatgtgagtgtggttgtgaatgatttcttttgaagatatattgtagtagatgttacaattttgtcgccaaactaaacttgctgcttaatgatttgctcacatctagtaaaacatggagtatttgtaaggtgcttggtctcctctataactacaagtatacattggaagcataaagatcaaaccgttggttgcataggatgtcacctttatttaacccattaatactctggttgacctaatcttattctcagacctcaagtgtctgtgcagtatctgttccatttaaatatcagctttacaattatgtggtagcctacacacataatctcatttcatcgctgtaaccaccctgttgtgataaccactattattttacccatcgtacagctgaggaagcaaacagattaagtaacttgcccaaaccagtaaatagcagacctcagactgccacccactgtccttttataatacaatttacagctatattttactttaagcaattcttttattcaaaaaccatttattaagtgcccttgcaatatcaatcgctgtgccaggcattgaatctacagatgtgagcaagacaaagtacctgtcctcaaggagctcatagtataatgaggagattaacaagaaaatgtattattacaatttagtccagtgtcatagcataaggatgatgcgaggggaaaacccgagcagtgttgccaagaggaggaaataggccaatgtggtctgggacggttggatatacttaaacatcttaataatcagagtaattttcatttacaaagagaggtcggtacttaaaataaccctgaaaaataacactggaattccttttctagcattatatttattcctgatttgcctttgccatataatctaatgcttgtttatatagtgtctggtattgtttaacagttctgtcttttctatttaaatgccactaaattttaaattcatacctttccatgattcaaaattcaaaagatcccatgggagatggttggaaaatctccacttcatcctccaagccattcaagtttcctttccagaagcaactgctactgcctttcattcatatgttcttctaaagatagtctacatttggaaatgtatgttaaaagcacgtatttttaaaatttttttcctaaatagtaacacattgtatgtctgctgtgtactttgctatttttatttattttagtgtttcttatatagcagatggaatgaatttgaagttcccagggctgaggatccatgccttctttgtttctaagttatctttcccatagcttttcattatctttcatatgatccagtatatgttaaatatgtcctacatatacatttagacaaccaccatttgttaagtatttgctctaggacagagtttggatttgtttatgtttgctcaaaaggagacccatgggctctccagggtgcactgagtcaatctagtcctaaaaagcaatcttattattaactctgtatgacagaatcatgtctggaacttttgttttctgctttctgtcaagtataaacttcactttgatgctgtacttgcaaaatcacattttctttctggaaattccggcagtgtaccttgactgctagctaccctgtgccagaaaagcctcattcgttgtgcttgaacccttgaatgccaccagctgtcatcactacacagccctcctaagaggcttcctggaggtttcgagattcagatgccctgggagatcccagagtttcctttccctcttggccatattctggtgtcaatgacaaggagtaccttggctttgccacatgtcaaggctgaagaaacagtgtctccaacagagctccttgtgttatctgtttgtacatgtgcatttgtacagtaattggtgtgacagtgttctttgtgtgaattacaggcaagaattgtggctgagcaaggcacatagtctactcagtctattcctaagtcctaactcctccttgtggtgttggatttgtaaggcactttatcccttttgtctcatgtttcatcgtaaatggcataggcagagatgatacctaattctgcatttgattgtcactttttgtacctgcattaatttaataaaatattcttatttattttgttacttggtacaccagcatgtccattttcttgtttattttgtgtttaataaaatgttcagtttaacatcccagtggagaaagtt

SEQ ID NO: 2 - DNA, 20261 bp, Macaca fascicularis
  source 1..20261: mol_type = genomic DNA
gtaaaatcaaggtgcgttcagatgttggcttgttgtaaatttctgtttatattaataacataccaaatgtggatttgttttaatcttcggaactctttccggtgaaaacctcatttacaagaaaactggactgacaggtttcactttctgtttcatttctatacatagctttattcctaggacaccaacaccactcgctacccaaactgaaagcttccccgattccgccgaaggtcaggaaagtccaatgccgggcaaactggatttgctgccttgcgcagaggtgggcgggaccccgcctccgggccgggcgccaagttgagcagctggcacgcctcgcgaagccccagtcctgaagccccagtcctgcgctgcttcccgaggctccgcaccagccgcgcttctctctgcctgcaggtagggagcgttgttcctccgcaggtgcccacggcccagcatctctggctaactcgctgggcaccttaggacggaggatctctacaccctttctttgggatggagagaggaggagggaaagggaaggcgatggtctagggggcagtagagccaattacctgttggggttaataagaacaggcaatgcatctgggcttcctccaggcgcaattcagttttgctctaaaaataatttatacctctaaaaataaataaggtgggtagtataggataggtagtcattcttatgcgaccgtgtgttcagaatatagctctgatgctaggctggaagtctggacacgggtcctagtccaccgtcagctgcttgctagtaatatgacttgtgtaagtcatcccagctgcagcagataagtaagtctcttcctgcgctaagcacgtccaggacccctgaacggaatttatttgctctgtccattctgaaaacccaaaggagtcctaaaagaggaatggaggagcctaagaataaaaatagtataataaaacatttcttagacatgttgaccttggcctatgtcaaagttcagtctgggtttgtcttataacataaggagtaaaagtaccattgttctacctctttttttaatacttgaaaaaaaatttactgtagatgcttttctattaattaaataaccttctaaaaaatgtttttagtgctgcattcgattaggttggataactaaatgaaattaattcctcactgttgggtataaaggttatttacagtggttctgtcttagctattcactgaacatcattacatagatatctctggaatattgctgattgtttccgtcaataaacttagaagtgtaactacttagtcaaagagactgaatattttaaaggcattttgaagaaaactgaaaatgctttccagaaaggatgtatcagttgacaatgatggttgtcaacagtatttaaggagaactatgatactctgaagaaaaacttagcctttctcagtagaagcaggtaggcagaggccacatgacagcagttagagtgtggtcttcaaggaagtcacagaaatactgtggggaattgaaaccccaagtggaaaatgtacaagagtgtctcagtgtgactgagaaggaggttgggcttggggtttaacttaagaatttttttctttttcttttgtggagatagggcttttgttatgttacccaggctggtcttgaactcctagcctcaggcgatcctcccgcctcaggctgcagaagtcctgggattactggccggagccaccatgcaggcctcttgctcctacttttgagaaaggaagcttaaccttttttttttgtttgtttgtttttgttttttgttttttttgagacgagtctcactctgttgcccaagctggagtgcagtggtgccatctcagctcacggcaacctctgcctcctgggttcaagtgattctcctgcctcagcctcccgagtagctgggactacaggcacccaccaccacgcccggctaatttttgtatttttagtagagatggggtttcaccatattggtcaggctgatctcgaactcctgactcaggtgatccacctgcctcagcctcccaaagtgctgggattacaggcgtgagccaccgcgcctggccacttgactttttctctatctcttccttctacccatcctacccttggaagatagagaagtaatatcagttccatcgtgttatactgggcttcccccagggacaaacccacttccccaacctgaatgagccatcacttcttccccagtttacatttcattgctctttgaatgtctccgttcggatatgggaattcacatgtggtcataattcttacctgaagaagactgacgtcttcttctcttagaccaactgccctgatgtgaggtttagaggttaaagaacatgtgtgtatttacatgatctttgtattctgccttttcgtccctcactaatgacagctgaaccccaaggaaatagagctgtggaggagagggtttgatgagaaagtaggtaaatattggatctaatccatcatcttccaggaaacctccattacttctaaaaatttcaaccaaattcgttaaaggacaagaactccaccagagtagggccataaacattggcaaaattagttgtaatctatgactagatttaatgtccctttgttttattcacatatggttataatgctttgcttggaattaggggtattttaagttttcttctgcctagtaagtgtatttgtgcttataatacaataattataaaatatcacattaatattttataactgtacagttaactctggcccaaggaaaagatagtccggtagatgctgcagcctgattttgtatctaaccctggcaagaggataatgactcatgttatttcacttaccctttttatcttttaacatgaagggctcatataggtcaataagaaaccagtgatataaacagaccaaaaaatgatcagatctttcacattagcaaaaaaaaatattttttaaacaatacccaactgggtgaaaatacagtgtaacagtaccaaatatcaacatgtgtcaagaaccagaaaaatgtttgttttctttgatcagcaacactatttgaggaaatctatcctcagggcctagcctggggcctggcacacagtaggcactgaacaaatatttgctgaacacacacatacttatgatatttttaaaattggcaacaatccaatacccaataatagaggaattaaatattatagaactgttcaataagatgcttacgaatatcatgcagtaagatgggcaatatttatatcataagcttaaatgaaacaaatgggtattaaaggtatggtaaggttataaattactttttaagagattaaagggaaaagactgaaagatatatactgaaatgctcacagtggtgacaaggttccccagccttggcactattgacattttgggctatgtctttgctgtgggaggctggcctgtgctctgcaggaggtttggcagcactcttggtttctacccctagatagcagtagcaaccctccctcaaccagcccaattttgacaaccaaaaatgtttccaggcatcaccagattctccctgggtgagagtgatgaaacagtaggtgattttccccttcttttctcattttctgtaattttgtcacattacgttaataataaggaaaaaacataaaaaatagatgaatttattattctacctcagtttggatgtttggactccctttgggggttctttccattatatcacttggtctgctaaacagtctatggtttggcaaggtgaaatgattcatgaaattttgtttttattttttacctgatactaaaagtaaaacattcattcgcttgaaaatttggacacagaacaccaaaaaaaatccataatctcatctctctttttctgtcttttccttccttttttccctttaaaaacaagagtgaaaacctaccggttctccctccaatttaattcctaaatataatcactgttaacatcttggacatttcctgtgtctaaacacacatactcactttttcttttttttagcaaaaagtggatttctgctacatgtagtgttccgcaacttcctacatgtttacaaaatcagtacatttacatatgctgaattcagtccttaatggtattatattttgtgaatataacaaaatttatttaaccacttagacaatctaagatattctcagtttgctgttatgagcaatgctcttcctttacatatacatatatatgtgtgtgtgtgtgtgtgtgtgtgtgtgtgtgtgtgtgttttagtaggatagatttctaggagagggcgaaatgtcatatgacatccacatttacaattgtaataggaagtatcaaagtgccccctaaaaaaaaaaattcctcccattagtgtgtgagaaagcctatttgttcatatcttcacaaacactaaatattagaaatatttacaattgtgttcaagctaagaagtgaaaaatggtatttcatatcttataatttttgttgtgagattgaacatatttcctatgtttacatgtcacctgtatttcttattctctgaactatacgttatgacctttcacttattttcctcatgggttatgtgtagtttgtgtagttgtcttattgattgttaggagctatttatatattaggaacattaatctcctgtcttatatgtatgtggcattgattagttgatcatttgtgagttcatgtctgtatacaaagattagagaggcagtaagagggaaaacttacctctttcttatcaaagtttgtaaatatatgtataacagaagagagagaaaacattaataaatgctgaaataaagtataaattttttactccactacttcaacataaactacaaaaggagagtgacttttctttcatgctgacttccatattccccatgcctaaaatagtgcctagcacagaagaggtgctcaatcagtgtttgctaaatgaaagaattagtaacatttcaagcaggatgactaaatgaagaatagaatctaggcagatactctggaagagtgactgtgagtcattcatggtcttggtatgaattagtcaaatccagctttctccccttcccactccccactgttagtagaataatctgtttattgagagaatagatttataatttagaataagaggggcagaagaggagattttgaaggatggcacctgaaggaggactagcatggctgagatagtgaagtggaagtcttggaaagctaaagggtaagatgaaagtatttagccgtagggggaaaaagcattgacaggttggaaatgtaaaagtcagattctccttgctttgaaattttgtacagggcaggttctactaggtatgttacaatgcagaaaaaacatgaaatagttgagaggaatttggtgaaatattatcttcctggcttcttttgagtgagcagatttttttcagggcctgtaactataataaatttgaaacttctcatcttttagtaacttttttcacttaagtttatgtggctgtgggcaatggaatgaaggtattgaacttcctattccctgctgggtttccacaattacaagtcaatcatgactggttattagaagactatttcaattagaaccaccaagtcccataatgtcatattgtgtgtttaattattaagtaaagcagtcttctttttgtgttttccataattagcacattccagaaagatgaggatatttgctgtctttatattcacgatctactggcatttgctgaatggtaagacaccaaatccttccattaggttctatattttaaatattttaaccatgagtttaaaactaaaatgataatttaaaatgcatgcaattttcttatagagagaatattctcttctttcttctactttacacaatgacaaagtctttcttctgctttacacaatgataaagttccctgtgtcattgtgtaaaaatatagagaatatagacaaattgaaagacacaaaataatctattacccatttcccagggttaactactgaaaatatctggggaaatggcctgtatgtatatatttatttgtttgttttcaacaaggccaggatctttcaatctttcaatcttggttgctctgtgacatgcctttcctgatgagaatactctaaggaagaattgtaggatacatggaaaatgtcagggtaacacagtactggcaccaccctgcggtcctttctgaactccataccaatgtacttcttgccagaaaactgatcaaaagtttagggaagtaaaaagagatgttagaatctaccattccctctatgtaggaagcaaataggtgtccagtcaaaggacattctggggatgtctacatgaaaccaagtctcctggttgtaagtactccatctccatataatatttctacagtaatatatgtttataaattgtgggggcaacttgtttagctaattttattattctgttattgggacactatgtctctgcatgagacatagtgtcccaaaacatatttcaagcccattggataaaatatgtatttagcaagttcttaaatataatgataacataactgaccagataaggtgatttttaaatgctgtgccaactttataaatgttttgaggaattttcccttttctgaaggttattcttctttctttttagcatttactgtcacggttcccaaggacctatatgtggtagagtatggcagcaatatgacaattgaatgcaaattcccagtagaaaaacaattagacctgacttcactaattgtctattgggaaatggaggataagaacattattcaatttgtgcatggagaggaagacctgaaggttcagcatagtaactacagacagagggcccagctgttgaaggaccagctctccctgggaaatgctgcacttcggatcacagatgtgaaattgcaggatgcaggggtttaccgctgcatgatcagctatggtggtgccgactacaagcggattaccgtgaaagtcaatggtaagaattattatagatgagaggcctgatctttatagaaaacatattctaagtgttgaagacttttcattcttataagtccatacttattttcaaacagaatagcatagtctcttcattcattcattcagttcatgaattcattcacgtaagtctccaattagcatttcttgagcacctatatgatagtcattggaaatccagagacaacacagagccatgttctacggtatgtacagttttccaaaaataattcctagtctttacttttttattataaatgtaatacatatacttgcaaagaattcagatactatggaagagatcaaatgaattgcaaaagtgtccctcctcccttcaccactatctcccatgagataaccaagagacactccaagagagtaaccattatttgtgtgtccctccagaaccttttttattcaactaccatttttttattttattaggtctgtcagttttccttttttgagcctctctatatcaaatgctaataaatatattcagatcaaaccccactgtaaggttcatattaaaaaagacttgaagtctccctatgaagacaaaaaataatcatattaagtgtaaaagaacttattcttccagtacagtataaactatactcactgggcatatattcatcttgaaaatctatactgatgttgtcttggggaattgaagaggaactaggagtgtcaattcctgggaactgacccacagttatgtcatcaggtcacttgagttcgaagttttgtgttggcactagctaagtaaaggaaaacacctctgctttcattgttgagtttcatagaattgagagctgaaaggatcccaggcaggagcgactaatccaaactcccacaaagaacaaaaatcccccagaggatcttctgttcatatatttcctgcagtggcatccctgtcatatcccacaatggcatccctgccatttggactccccttccatatcctgttgaaattactccctaatagtaagctgaaatctgcccctctagttgtagttttggaattatttcatttccatgatgaccttttaatatttgactagaattaaatcatctccccttggtatttccattcctggactaactaccatcaatctgagggctaacaatacaagtagaaaaagtctacacttgtcattgatcactgatcaatgattaatcaatgatcactgataattataaactcaaaaacaaaatcatgtagggattaagagaaatgtatcagttttatgttgtatttctggtccctgattctggctcaaataatgctactattgtcaagaagatatcacttgtaaagtagatttaattttcattatattttaccatgtgcttctccattcacggcatttcttgagatgttgtggtttatactttcagtttttctccagtccatcagcaaatatcaggcatctactgtgttccaagatattaaagaaatcatcatgacttagcctcatcaacagcattgctagatctgggatggaaaagaagagtataatcctggcagtcaggaagaaggctgcataaagtataagtttctgcttccaaagaagatctctcatcagcctgtagggagtgtatagggaggggacagctgtccttgtagtagcaaagggttttattcaggtcatctgggctccataatatcccttgtgtatctgcagtctcctttgccatggatcaacacaataggaaatcttccggcactgatggtttttccaagggggagttcttcagggagcaaagcaaatgaccaaccaggtttgaggacctgatttgacaattccattttgtattttaaattagttaatttgcattctagtcccaatccatcttgtcatttgcagacagtggttttggggttgagttgagctataccaaaagtctgaaccttctgcacttagaacaaggaaggcaaccaccaagcttcacttgcactgaggcagtgtctccaatggaaacgaggtagctggcttgcagaagctttccaactcagggaagtagaactcctgagtcacctccatatgcaaataatttcacagtactgctgttgaacttcacttcccatcacagcaaatgtgtggtaacatagctttgccacaggagtttactcaccatgggattttaaaggtgaaacatttcaaaactgaaatttgaaagaatttagttttggattcactcaattatcatgatcactttgggtgttattgcacctttcatgtttgtgagtttaaataccagactctcaggcctctaactttcaattaaaagtgtttttctttaatcactgaacctaatagtagggaaaacgaaatgttcattcagactttcaggaccttcaatgagatgaggcagctgaaagatcaaagtgttgcatagttatcccagtaaagctatttggatcgtatggaccagatcaactgctgtcattccccaccaaccccatctttccccaaaattcccagccctgtttaagtgttctctgtagcatttatctctatctagtatattgtgtagcatatcatatcatacttttctattttgtttattgtctctctcctcctagaatataaactccacaagcacagagatttgggtctgttttttaatattgttgtatccccagggcttgacgtaaagcagagtggtagtatgacaaaagcacacaaaaaaatatttgttgagtcaatgaatgaatgatttcctcaaataggattagcctaaaattttggaaacatgaacagacttggatatatgaaaatttatttccaaaactgttcatcaggaactgttagcaccttctaaagggtacactgaagcagcagtagtaaaaggaggaggaggagaagcagctctgctactactattatcgagtactactacaactatcgagtactactacaactatcgagtactactacaattagcacttgcttattctgtgtgttaggtcctgtactgaacattctgcctaaattagttcatttcctcctggaaatgactctgtggggtaggtgcttcatcatgtaagatgagtatttttcacacttcactgtctctgaaatctgagtgtgtctttcaatgatggaatctttgatttcatgataagtggtattattcccattttaaggatgaggaaactggggtccaaagaaattaagtaatttgcccaaattcacctagcctcgtaaatgataaagctagttctaaatccaagcagattggctctgaagtctgggcccttaataaccacttattgcctgtatttgcacctctggtgtatgtatcaagttatatattggcttcaaaactatcatgaccttttcttgattttgattgttcaatattagtatagtgttctagatctagtagaccaggggtctgcaaaaaattttgattactcacctcatctgtaaaacattttaaacttgtgtgtctgtgcaggcacatttgtgtgtaattataaaaaatttactatctattaatatataggttgtaccgtaagaaaaattgccatttttgaagagcaaaaaaggttgaatattaccagtttcatctggttcaacctaatagacatttgtacaaaaacagacattttaagaggatgaaataaaaatttaataaacaatattttcaatttttactaattgtgacgcttcactattgttagctaatatgtcaaggcatgatataccttagggtggaatttatcattaacaaaggtggatagtgtcaataatcttgaggtttgtgtttttttatataacactgtgaggtctaattaagtacttaattgtttacaacctcatacagtcgccaataataagtgtcacttctgctgtttcctctgggttgtgcttgaattattagtattatcttcaatcctcagtttctttgtggaaaactttttaattagttgtttaattttgtaagatggttagtttagtcaaaattagataagagaatctgaaaatccataattaccccaaagcaacccactcataagaactattatttttgtgttttgaaatcataattttattgatttccagtgtttccactggtagtggtttcattgatgtaggagtatcaaaacatcactaattatttatttcagttttgtttgatcctagctgttttgtgttaactttgaagaaattacatcacagatctattgttgtccttggtaaaggaatggagagttaaggctctagatcattagtggttatgctgtagtattaggagtaaaaaaaaagattatatcaacaaaataagaacatgttaatgtacttgtaatagataaacatgaataaagctcttatgctatatagatgcactgaacaatctactagaattgtcagcaaacggtatcttaatcctaaaagggtcccaaaccaatgatctaaaattgaatcaaactttcttccttgagcataattatttaagtgatttattaaaatagccagcatttaaaagcttaaaatataagtatcataatgtggtatcctagatagatcccagaacagagaaaggatattagggaaaaactggaggaatggaataaattatgcagtttagttattaataatgtactaatgtccttagttatgaccattgtaccatggtaaagtaagatactaacaatagaggaaattgggtaaggggtatatgtaactctatactatctttgcaatttttttgtaaatttaaaacttctaaaataaagaacaaatttgaacattaaaaagtgtcgccaggaacatgtatcactgtttacagatgaaacagtatgtatttttatatctaatttctgatcattggcttcaaatcagaaaagtgaatgacacatcaagatcaggttttctgtttactaaataaagtctaagaaaacaaagcataccagctggagagattcatgtttataaagacagatttataacaacaaaaataaaatatccaagaataaatttaagaagaaatagggcactatgtaaaaagtatagcactttactgagaaacatatgaaaacctgaatacatggagagaggtattttatatttgaatagaaagattgctggtttaaagataattctctttaaattttttttgtagaaatttaagaggtacaagagcagttttgtcacacggatatattacatagtggtgaagtctggggttttagtgtaaattaatctttacattttgtttgagcccaataaatgtaccaacatgatttttatagcaagatagtcattcctattaacccaaacttgtcccaactttgaactgaactgaggcagagctagcaggtgttccccactgctgaggcatctgaacattaagcgtatccctctgagaaccagcctgcattgatcctctttctaatgtagacagcatcaagctatatatctagttctgtgctcagcaaaagccctgacttctttttgcttatgtcctagctccatacaacaaaatcaaccaaagaattttggttgtcgatccagtcacctctgaacatgaactaacatgtcaggctgagggctaccccaaggccgaagtcatttggacaagcagtgaccatcaagtcctgagtggtaagaccaccaccaccaattccaagagagaggagaagcttttaaatgtgaccagcacactgagaatcaacacaacagctaatgagattttctactgcatttttaggagattagatcctgaggaaaaccatacagctgaattggtcatcccaggtaatattctgaatgtgtccattaaaatatgtctaacactgtcccctagcacctagtatgatgtctgcctatcatagtcattcagtgtttgttgaataaatgaattaatgaataacattatatttacaaaatgtatcctaattcctcacttccattcatccaaatcatattgttacttaataaacattcaccaaatatttattgaatatgccttttgttccatgcattgtagtactcatttgacacacatagaataataagactcacgttcacactcttcaggaaacagataaaaaacaaatgaacaaacaaaaaacaggcaatccaataccatgtgggaaatgctttcataccatgtgggaaacctgggggaatacctgagaggaatattcaattcaggccatgtttcaggaatccaaatcctggcacatcagagccgcctccttcttactagggtttctgtggcaggaaataaatggaacgtatttttctatcttatgccaaacaggagggaccctttctcccctgtgcctctcccaaggtagtctacaatatttcaacgctagcagtctgtttagtgcacaggacatgaggctgtgtatccctgggcaaattgctacacttctgtgtgcttcactttctctgtaggattataacctactgagcaaggttattgtgggggtcaaattagcaacagtgtatgaaaatgatttgagaccagtgcctgcacaaattcaactatttttttttatctcactactctatagaagtaggtaggatgggagacagagtctgatgggaggctcagaatgtgaaagtaagtgaggtgagtgagcatgatatttcatataaacacaaagatactctgagaagagcttctcacttcccccgcccccaatagatgttgacaggaaaatgccatgtacttcagcaaaaacagctgaaaaattagacataaaagtcaatcaataggaaaagataatccaggatggtcttgtgaacagaaagagggaaaaaaaaagtttagaaaatgatggggatgctcttactggggtatgagtcctcaggtattcaactggctttcagaaaaagctagactagtgggttcctgccatttaaaagctgttttatgacaacttacttgttgggtggcctacagtaactcacttaactgtgctgagtctgtttcctcatctgtaaattggggattttttaaaataactggcatgcctaactcataaagttgttctgaaactgaaataaaacatatatgaacaggcattgtaaactgtaagttacggaaaaagctggctgttgttgtgtctttaaagcttcacctgggtagttagagatggatcatgggtctcagtggagagctgagccaggcaggagctgactaagggtaagaggtgggagttagcaatctctgaacatctgtgtgccatgggaccccttttcctcctgcatggtaccccagacaaggagcctagtaagagatactaatgacttgttgtccagagatgttcaaactgcagagaaagataagacaacaagcattggcctccaatcatgatgacagataggaggaggtgggagctccttagcagtgctggttggttttccatgttctactgtgggccatctctgccatgtactgtaggctactaacttctatattaaaaaatgcaagaggggccgggagtggaggctcatgcctgtaatctcagcactttgggaggccaaggtgggcagatcacttgaggtcaggagtttgtaaccagcctggccaacatggtgaatctctgcctctactaaaaatacaaaaattagccagatgtggtggcgtgcacccgtaatcccagctactcgggaagctgaggcacgagaattgcttgaacctgggaggcggaggttgcagtgagccaagattgtgccactgccctccagcctgggcaacagagaaagactttgcctcaaaaataaataaataaataaataaataaataaataaataaatggaagtgaaataatcaaggccaccatttaatactgagtagccactccatgtggtactgtgctaagcacattataaaatattagcctcacaagaaatgtattagcatttgtattttgtacactggttaagtatcttgcccaagacctcaaaactggttaaggggcagcagaatttaaccccagcgccaccttttcaaagtctgggcttcttacacttctccatgctgttcccattttaacagatgtatctcgccattccagccactcaaactttggcatttaagaaaattatcctaaagctaaactaaacttcaaggatgactattctcctgatgaccccttcccatcaaaattttatctttagtcagtttgtttttgttttgttttgtttttcagaactacctctggcgcttcctccaaatgaaaggactcacttggtaattctgggagccatctttttactccttggtgtagcactgacattcatcttctatttaagaaaaggtagtatttccttaattgcagtggtctccactggggatgaggagggggtgagaattggatcgatcatggctgcaaggaaacctgacttaacctctgcagggtggtgcaaaggcattccactattcaacagtaattatattgaagctgcatgggatcactgggtgaagatgaggtgtaaggggtgagggacaggagaatgggtatggatggaggtagaagatgcagtgtcatacaatttttttctatcatgaaaataaccacagacttactgtaaagaaggagctaaaatgcctgtcattttcagttgcattttagttttgcattagttgcacccagctggtttctgggtactctaagtaataaaaatagttcctctgtagaactgtagtattttcaccatagagtattttgtaaaattattggtagaggatgttacataatttgcatgtgttcctttctccatttacctgtgggaacaattaaaatccaggaaaatgagtatattcaaataatttcctcccatttatgatgattcagagtaaataattcctctgatacttagagaagtataccaagagatccagtgattgtatagagttgtctgatgttaaatagggaagtagaatatggaagggaattccaatagtcgttgaaaaattccccacaaccccttacatgggggaaagtggtgttaactgagatagtagagataagctgttaccaaaaattatgttcttaacaggattgagatagccagaatataaggatcaagtttcaatgacagtaagatcctgagatgcagttgatttgcacaaagaaataattgttgccagcttgcattttgaatatttctctggaaaaagagattagttggcagtagaaatgaatagaaatcaatagatattaaaatacctcagaatttgattcatctctgggaaaagatgaaaaataaaagtgtatagtcctcaagaaaatctgggatcaaaagcatgggccttaccctattgaattaattaacctcagaagttgggaactgtggaataaggatgtccaccagacttcctagggattacaaatgtttcatagaacttgaaatttaaacttgggtcactgtatgggatgtagagctgtgctatatggaaataaaaatgatttctttttctcaagggagaatgatggatatgaaaaaatgtggcattcgagttacaaactcaaagaagcaacgtggtaagaatatcagaaggaattgggaagtagaaggcaaaggaaacaaaaagctaaagcaataacaaagagaaatccattagtcataatctcctctccttttaaagaatgctggttcccctttgcctcacaactaatacaagaacttctccaccatctcaggaagtttagggatggccttcaagagtagagagtagggagcagctctgtggagagaggagaggagcagggaaggggaaggagtcagcttctctttgctaatctgttgccctgcaccctagcagctccctgcagcaggggacaaggttgacttaggtggatggataattaattgattctaaaatattgtgtgtcagtattgtatattgtaatactatgttaactgcgccatgcacggtatctcatttaatcccccaccccttgccattaccaaaaagagagagagaaaaatactagaattatcctcattttacagtagagaaaacagagggtcaagaagataaagtaaagtgcccaagaacacacaactgatcacaaatatcaagcttggggtccattagcctaaccacagacccttactcttaacccatctgcttcaatccattttgctacaaatgtttacatttatatgcagggcagaaaagtctcatccagtttattgaactaagaagaaagttatattaaggtgtctaattttttttaatgtagttagaaaccaaacttaacaatgagcccaagtttaaagcagtctaattaacttgacaagctcaggcaagtttcattctgtggcctgtagcatcatctgtgttgtaaagctaagtagcaaatgttatttgggtcatcctggggggaaagtcatcccaatttgctcaagactgaggggtttttcaggatatcatgtaaggataattgggtacaaatataacctgcttctttctctcatttcaaatttatcatttatcatctcagcaactatgagttatgttttttattagatttcttgttactttttccccagaccgctccccatgaaattaatatactattatcactctccagatacacaattggaggagacgtaatccagcattggaacttctgatcttcaagcagggattctcagcctgtggtttgggggttcgtcagggctgagcatgaccagaggaatgaatgggcccgtgggatgcatgcagtatgggacttaaaaggcccaagcactgaaaatggaacctggcgaaagcagaggaggagaatgaagaaaaatggagttgaacagggagcgtggagggagaccttgatactttcaaatgcctgaggggctcatcggtgcatgtgacagggagaaaggatacttctgaacaaggagcctccaagcaaatcatccactgctcatcttaggaaaacgggttgagaatccctaatttgagggtcagttcctgcagaagtgccctttgcctccactcaatgcctcaatttgttttctgcgtgactgagggtcccagtgttggaacagtatttatgtatgagattttcctatttattttgagtctgtgaggtcttcttgtcatgggagtgtggttgtgaatgatttcttttgaagatatattgtagtagatgttacaattttgtcgccaaactaaacttgatgcttaatgacttgctcacatctagtaaaacatggagtatttgtaaggtgcttggtctcctctataactacaagtacacattggaagcataaagatcaaaccgttgatttgtataggatgtcacctttatttaacccattaatactctgattgacttaatcttattctcagacctcaagtgtctgtgcagtatctgttccatttaaatatcagctttataattatgtggtaccatacacacataatctcctttcatcgctgtaaccaccctgttgtgatgaccactattattttacccattgtacagctgaggaagcaaacagattaagtaacttgccaaaaccagtaaatagcagagctcagactgccacccactgtccttttataatacaatttacagctatattttactttaagcaattcatttattcaaaacccatttattaagtgcccttgcaatatcaatcactgtaccaggcattgaatctacagatgtgagcaagagaaagtacctgtcctcaaggagcttggagtataataaggagattaataagaaaatatattattacaatctagtccagtgtcatagcataaggatgatgtgaggagaaaagctgagcagtgttgccaagaggaggaaataggccaatgtggtctgggacagttgaatgtatttaaacatcttaataatcaaagtaattttcatttacaaagagaagtcagtacttaaaataaccctgaaaaataacactggaattccttttctagcattatatttatccctgatttgcctttgccatacaatctaatgcttgtttatatagtgtctgatattgtttaacagttctgtcttttctattcaaatgctattaaattttaaattcatacctttccatgattcaaaattcaaaagatcccatgggagatggtttgaaaatctccacttcatcctccaagccattcaagtttcctttccagaagcaactgctactgccttttattcatatgttcttctaaagatagtctacatttggaaatgtatgttaaaagcatatatttttaaatttttttccctaaatagtaacacattatatgtctgctgtgcactttgctatttttatttattgtagtgtttcttatgtagcagatggaatgaatttgaagctcccaagggtcaggacacatgccttctttgtttctaagttatctttcccatagcttttcataatctttcatatgatttagtacatgttaaatatgtgctacatatacatttagacaaccagcatttgttaagtatttgctctaggactgagtttggatttatgtttgctcaaaaggagacccatgggctctccagggtgcactgagtcaatctagtcctaaaaagcaatcttattattaactctgtatgacagaatcatatctggaacttttgttttctgctttctgtcaagtataaacttcactttgatgctgtacttgcaaaatcacattttctttctggaaattccagtagtgtaccttgactgctagttaccctgtgccagaaaagcctcattcgttgtgcttgaaccctttaatgccaccagctgtcatcactacacaggcctcctaagaggcttcctggaggttttgagattcagatgccctgagagatcccagagtttcctttccctcttggccacattctggtgtcagtgacaaggaataccttcgctttgccacccgtcaaggttgaagaaacagcgtctccaacagagctccttgtgttatctgtttgtacatgtgcatttgtacagtaatttgtgtgacagtgttctttgtgtgaattacaggcaagaactgtggctgagcaaggcacatagtctactcagtctattcctaactcctccttttggtgttggatttgtaaggcactttatcccttttgtctcatgtttcatcgtaaatggcataggcagagatgatatctaattctgcatttgattgtcactttttgtacctgcattaatttaataaaatatccttatttattttgtta

SEQ ID NO: 3 - DNA, 20340 bp, Macaca fascicularis
  variation 1658..1881: note = n is a, c, g, or t
  variation 2742..2745: note = n is a, c, g, or t
  variation 2747: note = n is a, c, g, or t
  variation 2749: note = n is a, c, g, or t
  variation 4764..4802: note = n is a, c, g, or t
  variation 8775..8778: note = n is a, c, g, or t
  variation 8980..8984: note = n is a, c, g, or t
  variation 9161..9293: note = n is a, c, g, or t
  variation 9344..9348: note = n is a, c, g, or t
  variation 9840..9874: note = n is a, c, g, or t
  variation 9958..9973: note = n is a, c, g, or t
  variation 10437..10452: note = n is a, c, g, or t
  variation 10603: note = n is a, c, g, or t
  variation 10830: note = n is a, c, g, or t
  variation 10989..11006: note = n is a, c, g, or t
  variation 11105..11122: note = n is a, c, g, or t
  variation 11457: note = n is a, c, g, or t
  variation 13710: note = n is a, c, g, or t
  variation 14015..14049: note = n is a, c, g, or t
  variation 14518..14585: note = n is a, c, g, or t
  variation 14689..14699: note = n is a, c, g, or t
  variation 14707..14767: note = n is a, c, g, or t
  variation 14837..14865: note = n is a, c, g, or t
  variation 15703..15741: note = n is a, c, g, or t
  variation 17403..17415: note = n is a, c, g, or t
  variation 19122..19135: note = n is a, c, g, or t
  source 1..20340: mol_type = genomic DNA
ctgaaagcttccccgattccgccgaaggtcaggaaagtccaatgccgggcaaactggatttgctgccttgcgcagaggtgggcgggaccccgcctccgggccgggcgccaagttgagcagctggcacgcctcgcgaagccccagtcctgaagccccagtcctgcgctgcttcccgaggctccgcaccagccgcgcttctctctgcctgcaggtagggagcgttgttcctccgcaggtgcccacggcccagcatctctggctaactcgctgggcaccttaggacggaggatctctacaccctttctttgggatggagagaggaggagggaaagggaaggcgatggtctagggggcagtagagccaattacctgttggggttaataagaacaggcaatgcatctgggcttcctccagcgcaattcagttttgctctaaaaataatttatacctctaaaaataaataaggtgggtagtataggataggtagtcattcttatgcgaccgtgtgttcagaatatagctctgatgctaggctggaagtctggacacgggtcctagtccaccgtcagctgcttgctagtaatatgacttgtgtaagtcatcccagctgcagcagataagtaagtctcttcctgcgctaagcacgtccaggacccctgaacggaatttatttgctctgtccattctgaaaacccaaaggagtcctaaaagaggaatggaggagcctaagaataaaaatagtataataaaacatttcttagacaggttgaccttggcctatgtcaaagttcagtctgggtttgtcttataacataaggagtaaaagtaccattgttctacctctttttttaatacttgaaaaaaaatttactgtagatgcttttctattaattaaataaccttctaaaaaatgtttttagtgctgcattcgattaggttggataactaaatgaaattaattcctcactgttgggtataaaggttatttacagtggttctgtcttagctattcactgaacatcattacatagatatctctggaatattgctgattgtttccgtcaataaacttagaagtgtaactacttagtcaaagagactgaatattttaaaggcattttgaagaaaactgaaaatgctttccagaaaggatgtatcagttgacaatgatggttgtcaacagtatttaaggagaactatgatactctgaagaaaaacttagcctttctcagtagaagcaggtaggcagaggccacatgacagcagttagagtgtggtcttcaaggaagtcacagaaatactgtggggaattgaaaccccaagtggaaaatgtacaagagtgtctcagtgtgactgagaaggaggttgggcttggggtttaacttaagaattttttcttttcttttgtggagatagggcttttgttatgttacccaggctggtcttgaactcctagcctcaggcgatcctcccgcctcaggctgcagaagtcctgggattactggccggagccaccatgcaggcctcttgctcctacttttgagaaaggaagcttaaccttttttttttgtttgtttttgttttttgttttttttgtagacgagtctcactctgttgcccaagctggagtgcagtggtgccatctcagctcacagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactttttctctatctcttccttctacccatcctacccttggaagatagagaagtaatatcagttccatcgtgttatactgggcttcccccagggacaaacccacttccccaacctgaatgagccatcacttcttccccagtttacatttcattgctctttgaatgtctccgttcggatatgggaattcacatgtggtcataattcttacctgaagaagactgacgtcttcttctcttagaccaactgccctgatgtgaggtttagaggttaaagaacatgtgtgtatttacatgatctttgtattctgccttttcgtccctcactaatgacagctgaaccccaaggaaatagagctgtggaggagagggtttgatgagaaagtaggtaaatattggatctaatccatcatcttccaggaaacctccattacttctaaaaatttcaaccaaattcgttaaaggacaagaactccaccagagtagggccataaacattggcaaaattagttgtaatctatgactagatttaatgtccctttgttttattcacatatggttataatgctttgcttggaattaggggtattttaagttttcttctgcctagtaagtgtatttgtgcttataatacaataattataaaatatcacattaatattttataactgtacagttaactctggcccaaggaaaagatagtccggtagatgctgcagcctgattttgtatctaaccctggcaagaggataatgactcatgttatttcacttaccctttttatcttttaacatgaagggctcatataggtcaataagaaaccagtgatataaacagaccaaaaaatgatcagatctttcacnnnnananaaaaaaaatatttttaaacaatacccaactgggtgaaaatacaatgtaacagtaccaaatatcaacatgtgtcaagaaccagaaaaatgtttgttttctttgatcagcaacactatttgaggaaatctatcctcagggcctagcctggggcctggcacacagtaggcactgaacaaatatttgctgaacacacacatacttatgatatttttaaaattggcaacaatccaatacccaataatagaggaattaaatattatagaactgttcaataagatgcttacgaatatcatgcagtaagatgggcaatatttatatcataagcttaaatgaaacaaatgggtattaaaggtatggtaaggttataaattactttttaagagattaaagggaaaagactgaaagatatatactgaaatgctcacagtggtgacaaggttccccagccttggcactattgacattttgggctatgtctttgctgtgggaggctggcctgtgctctgcaggaggtttggcagcactcttggtttctacccctagatagcagtagcaaccctccctcaaccagcccaattttgacaaccaaaaatgtttccaggcatcaccagattctccctgggtgagagtgatgaaacagtaggtgattttccccttcttttctcattttctgtaattttgtcacattacgttaataataaggaaaaaacataaaaaatagatgaatttattattctacctcagtttggatgtttggactccctttgggggttctttccattatatcacttggtctgctaaacagtctatggtttggcaaggtgaaatgattcatgaaattttgtttttattttttacctgatactaaaagtaaaacattcattcgcttgaaaatttggacacagaacaccaaaaaaaatccataatctcatctctctttttctgtcttttccttccttttttccctttaaaaacaagagtgaaaacctaccggttctccctccaatttaattcctaaatataatcactgttaacatcttggacatttcctgtgtctaaacacacatactcactttttcttttttttagcaaaaagtggatttctgctacatgtagtgttccgcaacttcctacatgtttacaaaatcagtacatttacatacgctgaattcagtccttaatggtattatattttgtgaatataacaaaatttatttaaccacttagacaatctaagatattctcagtttgctgttatgagcaatgctcttcctttacatatacatatatatgtgtgtgtgtgtgtgtgtgtgtgtgtgtgtgtgtgtgttttagtaggatagatttctaggagagggcgaaatgtcatatgacatccacatttacaattgtaataggaagtatcaaagtgccccctaaaaaaaaaaattcctcccattagtgtgtgagaaagcctatttgttcatatcttcacaaacactaaatattagaaatatttacaattgtgttcaagctaagaagtgaaaaatggtatttcatatcttataatttttgttgtgagattgaacatatttcctatgtttacatgtcacctgtatttcttattctctgaactatacgttatgacctttcacttattttcctcatgggttatgtgtagtttgtgtagttgtcttattgattgttaggagctatttatatattaggaacattaatctcctgtcttatatgtatgtggcattgattagttgatcatttgtgagttcatgtctgtatacaaagattagagaggcagtaagagggaaaacttacctctttcttatcaaagtttgtaaatatatgtataacagaagagagagaaaacattaataaatgctgaaataaagtataaatttttactccactacttcaacataaactacaaaaggagagtgacttttctttcatgctgacttccatattccccatgcctaaaatagtgcctagcacagaagaggtgctcaatcagtgtttgnnnnnnnnnnnnnnnnnnnnnnnnnnnnnnnnnnnnnnnaaatgaagaatagaatctaggcagatactctggaagagtgactgtgagtcattcatggtcttggtatgaattagtcaaatccagctttctccccttcccactccccactgttagtagaataatctgtttattgagagaatagatttataatttagaataagaggggcagaagaggagattttgaaggatggcacctgaaggaggactagcatggctgagatagtgaagtggaagtcttggaaagctaaagggtaagatgaaagtatttagccgtagggggaaaaagcattgacaggttggaaatgtaaaagtcagattctccttgctttgaaattttgtacagggcaggttctactaggtatgttacaatgcagaaaaaacatgaaatagttgagaggaatttggtgaaatattatcttcctggcttcttttgagtgagcagatttttttcagggcctgtaactataataaatttgaaacttctcatcttttagtaacttttttcacttaagtttatgtggctgtgggcaatggaatgaaggtattgaacttcctattccctgctgggtttccacaattacaagtcaatcatgactggttattagaagactatttcaattagaaccaccaagtcccataatgtcatattgtgtgtttaattattaagtaaagcagtcttctttttgtgttttccataattagcacattccagaaagatgaggatatttgctgtctttatattcacgatctactggcatttgctgaatggtaagacaccaaatccttccattaggttctatattttaaatattttaaccatgagtttaaaactaaaatgataatttaaaatgcatgcaattttcttatagagagaatattctcttctttcttctactttacacaatgacaaagtctttcttctgctttacacaatgataaagctccctgtgtcattgtgtaaaaatatagagaatatagacaaattgaaagacacaaaataatctattacccatttcccagggttaactactgaaaatatctggggaaatggcctgtatgtatatatttatttgtttgttttcaacaaggccaggatctttcaatctttcaatcttggttgctctgtgacatgcctttcctgatgagaatactctaaggaagaattgtaggatacatggaaaatgtcagggtaacacagtactggcaccaccctgcggtcctttctgaactccataccaatgtacttcttgccagaaaactgatcaaaagtttagggaagtaaaaagagatgttagaatctaccattccctctatgtaggaagcaaataggtgtccagtcaaaggacattctggggatgtctacatgaaaccaagtctcctggttgtaagtactccatctccatataatatttctacagtaatatatgtttataaattgtgggggcaacttgtttagctaattttattattctgttattgggacactatgtctctgcatgagacatagtgtcccaaaacatatttcaagcccattggataaaatatgtatttagcaagttcttaaatataatgataacataactgaccagataaggtgatttttaaatgctgtgccaactttataaatgttttgaggaattttcccttttctgaaggttattcttctttctttttagcatttactgtcacggttcccaaggacctatatgtggtagagtatggcagcaatatgacaattgaatgcaaattcccagtagaaaaacaattagacctgacttcactaattgtctattgggaaatggaggataagaacattattcaatttgtgcatggagaggaagacctgaaggttcagcatagtaactacagacagagggcccagctgttgaaggaccagctctccctgggaaatgctgcacttcggatcacagatgtgaaattgcaggatgcaggggtttaccgctgcatgatcagctatggtggtgccgactacaagcggattaccgtgaaagtcaatggtaagaattattatagatgagaggcctgatctttatagaaaacatattctaagtgttgaagacttttcattcttataagtccatacttattttcaaacagaatagcatagtctcttcattcattcattcagttcatgaattcattcacgtaagtctccaattagcatttcttgagcacctatatgatagtcattggaaatccagagacaacacagagccatgttctacggtatgtacagttttccaaaaataattcctagtctttacttttttattataaatgtaatacatatacttgcaaagaattcagatactatggaagagatcaaatgaattgcaaaagtgtccctcctcccttcaccactatctcccatgagataaccaagagacactccaagagagtaaccattatttgtgtgtccctccagaaccttttttattcaactaccatttttttattttattaggtctgtcagttttccttttttgagcctctctatatcaaatgctaataaatatattcagatcaaaccccactgtaaggttcatattaaaaaagacttgaagtctccctatgaagacaaaaaataatcatattaagtgtaaaagaacttattcttccagtacagtataaactatactcactgggcatatattcatcttgaaaatctatactgatgttgtcttggggaattgaagaggaactaggagtgtcaattcctgggaactgacccacagttatgtcatcaggtcacttgagttcgaagttttgtgttagcactagctaagtaaaggaaaacacctctgctttcattgttgagtttcatagaattgagagctgaaaggatcccaggcaggagcgactaatccaaactcccacaaagaacaaaaatcccccagaggatcttctgttcatatatttcctgcagtggcatccctgtcatatcccacaatggcatccctgccatttggactccccttccatatcctgttgaaattactccctaatagtaagctgaaatctgcccctctagttgtagttttggaattatttcatttccatgatgaccttttaatatttgactagaattaaatcatctccccttggtatttccattcctggactaactaccatcaatctgagggctaacaatacaagtagaaaaagtctacacttgtcattgatcactgatcaatgattaatcaatgatcactgataattataaactcaaaaacaaaatcatgtagggattaagagaaatgtatcagttttatgttgtatttctggtccctgattctggctcaaataatgctactattgtcaagaagatatcacttgtaaagtagatttaattttcattatattttaccatgtgcttctccattcacggcatttcttgagatgttgtggtttatactttcagtttttctccagtccatcagcaaatatcaggcatctactgtgttccaagatattaaagaaatcatcatgacttagcctcatcaacagcattgctagatctgggatggaaaagaagagtataatcctggcagtcaggaagaaggctgcataaagtataagtttctgcttccaaagaagatctctcatcagcctgtagggagtgtatagggaggggacagctgtccttgtagtagcaaagggttttattcaggtcatctgggctccataatatcccttgtgtatctgcagtctcctttgccatggatcaacacaataggaaatcttccggcactgatggtttttccaagggggagttcttcagggagcaaagcaaatgaccaaccaggtttgaggacctgatttgacaattccattttgtattttaaattagttaatttgcattctagtcccaatccatcttgtcatttgcagacagtggttttggggttgagttgagctataccaaaagtctgaaccttctgcacttagaacnnnnaaggcaaccaccaagcttcacttgcactgaggcagtgtctccaatggaaacgaggtagctggcttgcagaagctttccaactcagggaagtagaactcctgagtcacctccatatgcaaataatttcacagtactgctgttgaacttcacttcccatcacagcaaatgtgtggtaacatagctttgccacaggagtttactnnnnnccatgggattttaaaggtgaaacatttcaaaactgaaatttgaaagaatttagttttggattcactcaattatcatgatcactttgggtgttattgcacctttcatgtttgtgagtttaaataccagactctcaggcctctaactttcaattaaaagtgtttttctttaatcactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtcattccccaccaaccccatctttccccaaaattcccagccctgtttnnnnngtttttctttaatcactgaacctaatagtagggaaaacgaaatgttcattcagactttcaggaccttcaatgagatgaggcagctgaaagatcaaagtagttgcatagttatcccagtaaagctatttggatcgtatggaccagatcaactgctgtcattccccaccaaccccatctttccccaaaattcccagccctgtttaagtgttctctgtagcatttatctctatctagtatattgtgtagcatatcatatcatacttttctattttgtttattgtctctctcctcctagaatataaactccacaagcacagagatttgggtctgttttttaatattgttgtatccccagggcttgacgtaaagcagagtggtagtatgacaaaagcacacaaaaaatatttgttgagtcaatgaatgaatgatttcctcaaataggattagcctaaaatttggaaacatgaacagacttggatatatgaaaatttnnnnnnnnnnnnnnnnnnnnnnnnnnnnnnnnnnnttctaaagggtacactgaagcagcagtagtaaaaggaggaggaggagaagcagctctgctactactattatcgagtactactannnnnnnnnnnnnnnnctacaactatcgagtactactacaattagcacttgcttattctgtgtgttaggtcctgtactgaacattctgcctaaattagttcatttcctcctggaaatgactctgtggggtaggtgcttcatcatgtaagatgagtatttttcacacttcactgtctctgaaatctgagtgtgtctttcaatgatggaatctttgatttcatgataagtggtattattcccattttaaggatgaggaaactggggtccaaagaaattaagtaatttgcccaaattcacctagcctcgtaaatgataaagctagttctaaatccaagcagattggctctgaagtctgggcccttaataaccacttattgcctgtatttgcacctctggtgtatgtatcaagttatatattggcttcaaaactatcatgaccttttcttgattttgattgttcaatattagtatagtgttctnnnnnnnnnnnnnnnngggtctgcaaaaaattttgattactcacctcatctgtaaaacattttaaacttgtgtgtctgtgcaggcacatttgtgtgtaattataaaaaatttactatctattaatatataggttgtaccgtaagaaaaattgccatttttgaagagncaaaaaaggttgaatattaccagtttcatctggttcaacctaatagacatttgtacaaaaacagacattttaagaggatgaaataaaaatttaataaacaatattttcaatttttactaattgtgacgcttcactattgttagctaatatgtcaaggcatgatataccttagggtggaatttatcattaacaaaggtggatagtgtcaataatcttgaggtttgtgnttttttatataacactgtgaggtctaattaagtacttaattgtttacaacctcatacagtcgccaataataagtgtcacttctgctgtttcctctgggttgtgcttgaattattagtattatcttcaatcctcagtttctttgtggaaaactttttaannnnnnnnnnnnnnnnnnaagatggttagtttagtcaaaattagataagagaatctgaaaatccataattaccccaaagcaacccactcataagaactattatttttgtgttttggnnnnnnnnnnnnnnnnnntttccagtgtttccactggtagtggtttcattgatgtaggagtatcaaaacatcactaattatttatttcagttttgtttgatcctagctgttttgtgttaactttgaagaaattacatcacagatctattgttgtccttggtaaaggaatggagagttaaggctctagatcattagtggttatgctgtagtattaggagtaaaaaaaagattatatcaacaaaataagaacatgttaatgtacttgtaatagataaacatgaataaagctcttatgctatatagatgcactgaacaatctactagaattgtcagcaaacggtatcttaatcctnaaaagggtcccaaaccaatgatctaaaattgaatcaaactttcttccttgagcataattatttaagtgatttattaaaatagccagcatttaaaagcttaaaatataagtatcataatgtggtatcctagatagatcccagaacagagaaaggatattagggaaaaactggaggaatggaataaattatgcagtttagttattaataatgtactaatgtccttagttatgaccattgtaccatggtaaagtaagatactaacaatagaggaaattgggtaaggggtatatgtaactctatactatctttgcaatttttttgtaaatttaaaacttctaaaataaagaacaaatttgaacattaaaaagtgtcgccaggaacatgtatcactgtttacagatgaaacagtatgtatttttatatctaatttctgatcattggcttcaaatcagaaaagtgaatgacacatcaagatcaggttttctgtttactaaataaagtctaagaaaacaaagcataccagctggagagattcatgtttataaagacagatttataacaacaaaataaaatatccaagaataaatttaagaagaaatagggcactatgtaaaaagtatagcactttactgagaaacatatgaaaacctgaatacatggagagaggtattttatatttgaatagaaagattgctggtttaaagataattctctttaaattttttttgttagaaatttaagaggtacaagagcagttttgtcacacggatatattacatagtggtgaagtctggggttttagtgtaaattaatctttacattttgtttgagcccaataaatgtaccaacatgatttttatagcaagatagtcattcctattaacccaaacttgtcccaactttgaactgaactgaggcagagctagcaggtgttccccactgctgaggcatctgaacattaagcgtatccctctgagaaccagcctgcattgatcctctttctaatgtagacagcatcaagctatatatctagttctgtgctcagcaaaagccctgacttctttttgcttatgtcctagctccatacaacaaaatcaaccaaagaattttggttgtcgatccagtcacctctgaacatgaactaacatgtcaggctgagggctaccccaaggccgaagtcatttggacaagcagtgaccatcaagtcctgagtggtaagaccaccaccaccaattccaagagagaggagaagcttttaaatgtgaccagcacactgagaatcaacacaacagctaatgagattttctactgcatttttaggagattagatcctgaggaaaaccatacagctgaattggtcatcccaggtaatattctgaatgtgtccattaaaatatgtctaacactgtcccctagcacctagtatgatgtctgcctatcatagtcattcagtgtttgttgaataaatgaattaatgaataacattatatttacaaaatgtatcctaattcctcacttccattcatccaaatcatattgttacttaataaacattcaccaaatatttattgaatatgccttttgttccatgcattgtagtactcatttgacacacatagaataataagactcacgttcacactcttcaggaaacagataaaaaacaaatgaacaaacaaaaaacaggcaatccaataccatgtgggaaatgctttcataccatgtgggaaacctgggggaatacctgagaggaatattcaattcaggccatgtttcaggaatccaaatcctggcacatcagagccgcctccttcttactagggtttctgtggcaggaaataaatggaacgtatttttctatcttatgccaaacaggagggaccctttctcccctgtgcctctcccaaggtagtctacaatatttcaacgctagcagtctgtttagtgcacaggacatgaggctgtgtatccctgggcaaattgctacacttctgtgtgcttcactttctctgtaggattataacctactgagcaaggttattgtgggggtcaaattagcaacagtgtatgaaaatgatttgagaccagtgcctgcacaaattcaactatttttttttatctcactactctatagaagtaggtaggatgggagacagagtctgatgggaggctcagaatgtgaaagtaagtgaggtgagtgagcatgatatttcatataaacacaaagatactctgagaagagcttctcacttnccccgcccccaatagatgttgacaggaaaatgccacgtacttcagcaaaaacagctgaaaaattagacataaaagtcaatcaataggaaaagataatccaggatggtcttgtgaacagaaagaggaaaaaaaaagtttagaaaatgatggggatgctcttactggggtatgagtcctcaggtattcaactggctttcagaaaaagctagactagtgggttcctgccatttaaaagctgttttatgacaacttacttgttgggtggcctacagtaactcacttaactgtgctgagtctgtttcctnnnnnnnnnnnnnnnnnnnnnnnnnnnnnnnnnnnatgcctaactcataaagttgttctgaaactgaaataaaacatatatgaacaggcattgtaaactgtaagttacggaaaaagctggctgttgttgtgtctttaaagcttcacctgggtagttagagatggatcatgggtctcagtggagagctgagccaggcaggagctgactaagggtaagaggtgggaattagcaatctctgaacatctgtgtgccatgggaccccttttcctcctgcatggtaccccagacaaggagcctagtaagagatactaatgacttgttgtccagagatgttcaaactgcagagaaagataagacaacaagcattggcctccaatcatgatgacagatagaggaggtgggagctccttagcagtgctggttggttttccatgttctactgtgggccatctctgccatgtactgtaggctactaacttctatattaaaaaatgcaagaggggnnnnnnnnnnnnnnnnnnnnnnnnnnnnnnnnnnnnnnnnnnnnnnnnnnnnnnnnnnnnnnnnnnnntcaggagtttgtaaccagcctggccaacatggtgaatctctgcctctactaaaaatacaaaaattagccagatgtggtggcgtgcacccgtaatcccagctacnnnnnnnnnnnaggcacgnnnnnnnnnnnnnnnnnnnnnnnnnnnnnnnnnnnnnnnnnnnnnnnnnnnnnnnnnnnnnagcatgggcaacagagaaagactttgcctcaaaaataaataaaaaataaataaataaataaataaataannnnnnnnnnnnnnnnnnnnnnnnnnnnncatttaatactgagtagccactccatgtggtactgtgctaagcacattataaaatattagcctcacaagaaatgtattagcatttgtattttgtacactggttaagtatcttgcccaagacctcaaaactggttaaggggcagcagaatttaaccccagcgccaccttttcaaagtctgggcttcttacacttctccatgctgttcccattttaacagatgtatctcgccattccagccactcaaactttggcatttaagaaaattatcctaaagctaaactaaacttcaaggatgactattctcctcatgaccccttcccatcaaaattttatctttagtcagtttgtttttgttttgttttgtttttcagaactacctctggcgcttcctccaaatgaaaggactcacttggtaattctgggagccatctttttactccttggtgtagcactgacattcatcttctatttaagaaaaggtagtatttccttaattgcagtggtctccactggggatgaggagggggtgagaattggatcgatcatggctgcaaggaaacctgacttaacctctgcagggtggtgcaaaggcattccactattcaacagtaattatattgaagctgcatgggatcactgggtgaagatggggtgtaaggggtgagggacaggagaatgggtatggatggaggtagaagatgcagtgtcatacaatttttttctatcatgaaaataaccacagacttactgtaaagaaggagctaaaatgcctgtcattttcagttgcattttagttttgcattagttgcacccagctggtttctgggtactctaacnnnnnnnnnnnnnnnnnnnnnnnnnnnnnnnnnnnnnnnccatagagtattttgtaaaattattggcagaggatgtacataatttgcatgtgttcctttctccatttacctgtgggaacaattaaaatccaggaaaatgagtatattcaaataatttcctcccatttatgatgattcagagtaaataattcctctgatacttagagaagtataccaagagatccagtgattgtatagagttgtctgatgttaaatagggaagtagaatatggaagggattccaatagtcgttgaaaaattccccacaaccccttacatgggggaaagtggtgttaactgagatagtagagataagctgttaccaaaaattatgttcttaacaggattgagatagccagaatataaggatcaagtttcaatgacagtaagatcctgagatgcagttgatttgcacaaagaaataattgttgccagcttgcattttgaatatttctctggaaaaagagattagttggcagtagaaatgaatagaaatcaatagatattaaaatacctcagaatttgattcatctctgggaaaagatgaaaaataaaagtgtatagtcctcaagaaaatctgggatcaaaagcatgggccttaccctattgaattaattaacctcagaagttgggaactgtggaataaggatgtccaccagacttcctagggattacaaatgtttcatagaacttgaaatttaaacttgggtcactgtatgggatgtagagctgtgctatatggaaataaaaatgatttctttttctcaagggagaatgatggatatgaaaaaatgtggcattcgagttacaaactcaaagaagcaacgtggtaagaatatcagaaggaattgggaagtagaaggcaaaggaaacaaaaagctaaagcaataacaaagagaaatccattagtcataatctcctctccttttaaagaatgctggttcccctttgcctcacaactaatacaagaacttctccaccatctcaggaagtttagggatggccttcaagagtagagagtagggagcagctctgtggagagaggagaggagcagggaaggggaaggagtcagcttctctttgctaatctgttgccctgcaccctagcagctccctgcagcaggggacaaggttgacttaggtggatggataattaattgattctaaaatattgtgtgtcagtattgtatattgtaatactatgttaactgcgccatgcacggtatctcatttaatcccccaccccttgccattaccaaaaagagagagagaaaaatactagaattatcctcattttacagtagagaaaacagagggtcaagaagataaagtaaagtgcccaagaacacacaactgatcacaaatatcaagcttggggtccattagcctaaccacagacccttactcttaacccatctgcttcaatccattttgctacaaatgtttacattatatgcagggcagaaaagtctcatccagtttattgaactaagaagaaagttatattaaggtgtctaattttttttaatgtagttagaaaccaaacttaacaatgagcccaagtttaaagcagtctaattaacttgacaagctcaggcaagtttcattctgtggcctgtagcatcatctgtgttgtaaagctaagtagcaaatgttatttgnnnnnnnnnnnnnggtcatcctggggggaaagtcatcccaatttgctcaagactgaggggtttttcaggatatcatgtaaggataattgggtacaaatataacctgcttctttctctcatttcaaatttatcatttatcatctcagcaactatgagttatgttttttattagatttcttgttactttttccccagaccgctccccatgaaattaatatactattatcactctccagatacacaattggaggagacgtaatccagcattggaacttctgatcttcaagcagggattctcagcctgtggtttgggggttcgtcagggctgagcatgaccagaggaatgaatgggcccgtgggatgcatgcagtatgggacttaaaaggcccaagcactgaaaatggaacctggcgaaagcagaggaggagaatgaagaaaaatggagttgaacagggagcgtggagggagaccttgatactttcaaatgcctgaggggctcatcggtgcatgtgacagggagaaaggatacttctgaacaaggagcctccaagcaaatcatccactgctcatcttaggaaaacgggttgagaatccctaatttgagggtcagttcctgcagaagtgccctttgcctccactcaatgcctcaatttgttttctgcgtgactgagggtcccagtgttggaacagtatttatgtatgagattttcctatttattttgagtctgtgaggtcttcttgtcatgggagtgtggttgtgaatgatttcttttgaagatatattgtagtagatgttacaattttgtcgccaaactaaacttgatgcttaatgacttgctcacatctagtaaaacatggagtatttgtaaggtgcttggtctcctctataactacaagtacacattggaagcataaagatcaaaccgttgatttgtataggatgtcacctttatttaacccattaatactctgattgacttaatcttattctcagacctcaagtgtctgtgcagtatctgttccatttaaatatcagctttataattatgtggtaccatacacacataatctcctttcatcgctgtaaccaccctgttgtgatgaccactattattttacccattgtacagctgaggaagcaaacagattaagtaacttgccaaaaccagtaaatagcagagctcagactgccacccactgtccttttataatacaatttacagctatattttactttaagcaattcatttattcaaaacccatttattaagtgcccttgcaatatcaatcactgtaccaggcattgaatctacagatgtgagcaagagaaagtacctgtcctcaaggagcttggagtataataaggagattaataagaaaatatattattacaatctagtccagtgtcatagcataaggatgatgtgaggagaaaagctgagcagtgttgccaagaggaggaaataggccaatgtggtctgggacagttgaatgtatttaaacatcttaataatcaaagtaattttcatttacaaagagaagtcagtacttaaaataaccctgaaaaataacactggaattccttttctagcattatatttatccctgatttgcctttgccatacaatctaatgcttgtttatatagtgtctgatattgtttaacagttctgtcttttctattcaatgctattaattttaaattcatacctttccatgannnnnnnnnnnnnngatcccatgggagatggtttgaaaatctccacttcatcctccaagccattcaagtttcctttccagaagcaactgctactgccttttattcatatgttcttctaaagatagtctacatttggaaatgtatgttaaaagcatatatttttaaatttttttccctaaatagtaacacattatatgtctgctgtgcactttgctatttttatttattgtagtgtttcttatgtagcagatggaatgaatttgaagctcccaaaggtcaggacacatgccttctttgtttctaagttatctttcccatagcttttcataatctttcatatgatttagtacatgttaaatatgtgctacatatacatttagacaaccagcatttgttaagtatttgctctaggactgagtttggatttatgtttgctcaaaaggagacccatgggctctccagggtgcactgagtcaatctagtcctaaaaagcaatcttattattaactctgtatgacagaatcatatctggaacttttgttttctgctttctgtcaagtataaacttcactttgatgctgtacttgcaaaatcacattttctttctggaaattccagtagtgtaccttgactgctagttaccctgtgccagaaaagcctcattcgttgtgcttgaaccctttaatgccaccagctgtcatcactacacaggcctcctaagaggcttcctggaggttttgagattcagatgccctgagagatcccagagtttcctttccctcttggccacattctggtgtcagtgacaaggaataccttcgctttgccacccgtcaaggttgaagaaacagcgtctccaacagagctccttgtgttatctgtttgtacatgtgcatttgtacagtaatttgtgtgacagtgttctttgtgtgaattacaggcaagaactgtggctgagcaaggcacatagtctactcagtctattcctaactcctccttttggtgttggatttgtaaggcactttatcccttttgtctcatgtttcatcgtaaatggcataggcagagatgatatctaattctgcatttgattgtcactttttgtacctgcattaatttaataaaatatccttatttattttgttacttggtacaccagcatgtccattttcttgtttattttgtgtttcataaaatgcttagtttaacatcccggtgg

SEQ ID NO: 4 - DNA, 20641 bp, Mus musculus
  source 1..20641: mol_type = genomic DNA
gcctcatgccaggctgcacttgcacgtcgcgggccagtctcctcgcctgcaggtaagggagcatcttctcgcggaatccgcttgcagggcactttaaagagccagaatccctagacctttttaggacggagaagggaaccggtttcctgggaaagttaagaactcagaatccgcagttttgtgtgtttatggatcttgtgggtaggtagctgggtcagaagagatgaattaattggtcctagcgcgacttgactgtttgctagcaatgactgggtctttccacttgaagcatctccggaggtcccttcctctgtcgaggtctaggatgctggagcttaagattttcattctatctgcccagagaacctaaaggatttttggaagaaaatgtcccaaacagttcttagatacagtgacctaggctatgttaaagtttaggttggggttgtcataagaggtgaaagtacaatattctatctttttttaaaaataaattattacaggtgctttcctatgaattacttagccagtttttttttaattgctatattccattgtgctgggttattaaagggcatcactctcccactgaggaatgcacaggttagtaatagtgccttactagctcagtcatccactgaccatctgtgtatgtgactgtctggaatatggctaggtatttcatttagataaactcttatatgtataagtacttcattatgtttgagtgtctgaaaggcctttgtgtagaaaaaaaaaaaacaacaacctgagaatacattccagaaagtatccgcagctgatgatgatagtgaccaagcggtgtttaaggagaactttatacagggaaaatattcacctttcccagctgagcatcatagataggaagacatgatagtggttatatgctgctctaaggagggatggagaagggatggatttgagcacagggttcaggatcatttgatagaatttgaaaactgggtaaattttcactcttttgagaaaggaagtttgcatctgcttcccctccccgccccaggcactcttcccccccccatccccccccgtgccccccccccccatgggaagataaagaagtggcgttccaagatcttcatctggacttcccctgggacaaacctatttccccatcttgaatgagcgtcacttctttactttaaactctgttctgtgaaaggctctcagctcttgtctgggaatttgtgaaaggttacagtttcttgccggagggagggagaaggtgaccctggactcttagcccatgtaagaggtgcaggtttagaggtcaaaggccatgctgatttacatggtccctgaatttccccttttgatctactgctcacacctgcaccctgagagccagggaggggaggatatgatactgaagaaggtgactatcagacccaacccatcacctttcagactttatactaagctttaaagcagactcataagcaatagataactgttccaactgagtctgccatcaacgtaggaaaaattaggtacagtcttcagtggatatcatgtacctcattgtgactgtctagtactcggcttggccatttctcccagggcctcattgcaacagtcactgtgtcctcacaggcctggatgtcatcctgcctcatctgcttgggcagatgaactggagagatatgattaataatgagtcatttgattttgctctttttgtaaatgtccttggtttggtttggtttgtttattttttgttttgttgttgttgtttgtttttattttcatgctcttgttgttgtttgagacagagtctcactatgtagcccaggctagcctcttcccccagtctctcagatgctgttgcatctgcccttttctaacatcaatgattcataataatcagcaagaaggctatgaccttaacagtcaaaataagtaatcaggtaattattgagagctaaatatttatttaaacaaatcaagttgcatttttcaagaattgaatggggggatctaaaaagtaatgtttgtgctgcacaaagatgtagtggtatcagttgccatagtctttctccctagatccgcagatctccttagggaaatctataattcaagcctaaacttggacctggtacacaactggtactcgcccaaacattggccaagcacacacatatttgtgactctgaaaaaagggacaacacataacagcaaaggcgctccgtgttaggggcctgttaaatacaagacttggggaaattatgccataatcttacattttaaaaatggctattacatgtgtgagacaacgggggctggagagatacctcagaggtactaggcacacatatggcaagcagatgtacaagcaggcaaaacattcttaaaaaacaaaaacaaaaccccaaaacagatttctttctatattatttatatggggttctgcctgcgtgtacacctgaagggcagaggagagcaccaggtctcataggtggttggttgtaagctaccatatggttgctaggaattaaactcaggactttggtaagagcagccagtgctcttaacctctgagccatccctccagtcccagacaaaacactcttacacataaaataaatcaatctttaaaagtgtagaggaaaatggctgaacagaaactattgacagacatgctgagagtggtcaccgtttctccagcttggcactggtggtgctgtaggccatctcagtgtctgtcaccttggggcggggcggggggcgggagggggggaaggcggcagggcagggtcttggcagcatctcgggcctctatttcatcacatcagtaacagctctccttcgtcccaagcaagctttggcaaccaaataaatatgttagccaatattaccaaacggtccctagaggagaatgtgtgtaatgtgcctacattcgtttttataacaacaccaacaatatccaaccataaaaataaactgaaatggtcactctacctcagtgacaacgtctgagctccgtttcagggtccctcacaagaaattcgataggtgtaatgatttatttttcctaataagtaaaatgattattcactcatttgaaaattggacacacacacaaaaaaatgaagaaaaaatttgctatttcatctctccttttctatctctttccctttaaaaaaagtataaatgtgggctaaagagatggctcagcagttaagagcactggctgctcttccggaggtactgagttcaaactgcaccaaccacatggtggctcacaaccatctgtaatgggatctgatgccctcttctggtgtgtctagagacagtgacagtgtactcacatacataaaataagtaaaaaaaaaaaaaacaaaacttttttttaagtataaatgtgtaagaacttacctgtcttccctataaaagccacaattacctttgcagataatcactgtcaggcagtgtcttcaagagaagtggggttgttctacgacacaagaatatttttgtttatatactaccctctaagctccttcctacttctctgcaaactcatcccctgtgcatatactgaaatctatccgtcacggtattttgagtatacacagttatccgtcacggtattttgagtatacacagttttattagctaatacatggggtatttcaagtctgggactgttgttggctgtgtcatctctgttacatatgacttatattttctaagatgaatttccaagacaggaatagagagatcatacgacatgcacagttaaagttttaagagattacaaaattgacctttaagaagctatacaatttcacatcctttccaggaaaggtcaagaaatccctgtatcttcactaatgctacctatgaggagtctgtaattttggtagagcagaaggtccaaatggtatcacagatcctccatggactttcttatcgagagcgttctttccgcttttattgattatccttcgagctatgtgagactctcatccgtcttcctcttgaccgatgtatagttttctcactgagttcagaggctaggatgcagaagccgtcctcgtcagctttatacacctttcagattgactgtgaatgagcacacaggtcagagagacggtaagggaagacctactctcccatgaacgttgtaaacatgcgaataacacagaagcagaaaatgtaaactattagactggctggaatgtagcgctcacctttgagcccactcctttagacaccggtttcatggaagaatggctcctgtttcccacctgctgcttcagcagtgccccaaatagtgccagattcagaggagatactcagtgtttgccgagtgaattaggaaagtgttcagcggaggggacactagcattcagacatccagaccttagagtaaccgggccagatggaagtctccttccttcccatagctgttaccactgtactgtctttactggggaaaagatttatcatgtggaataggtgcgaggcagaggtgagattttaatggggaggaagcattgaaaagtgaaagtgaaaattggatgctctttgctttgaagctttgcctaaagcaggttttagctttcaaatacgtttcaatgttgaaagaacgcatgatacatatggaggggggcctggggggggtccttggctgagtttgaatgtacattaacaatctggggggctaataactcaatgtaaagctgctgatcccatcatactgacttctttccacttggttctacatggctttgagttacaaaatgaaagcattgaattttgaactgttcagctgtgtttccacacttgcaaatcggttgttggccagccctcagaattgcttcagttacagctggctcgtctgctctttccagactggcttttagggcttatgtatatatgagaaggacacatttactagtgtctccttgctctgctattgaaattaagcagacctctctgtgtttcccgttactagatagttcccaaaacatgaggatatttgctggcattatattcacagcctgctgtcacttgctacggggtaagtcaccaaatcttttcagtgggttctatattttcaatattttagctatgaattaaaaatggaagtaatttgtggggtgtgtatgtgtgtgtatatgtgtgtgtagaggggggtctgtgtgtatgtgcagttgctaggcacacataaagcgttcataggacaacctagagcttagtcctcaccttctaccttgtttgagacaaggtctcttatttgttgtacattgctgagtcctgtagttcggctagctcagaacctcctgggggctctcctgtctccacctcccagtccactgagattgtaggcacatgctactgcacctggcttctacctggtctctggggatttgaacttgggtccatgggctacacagcaagtcgtttacttactgggcaatcactccatcccctaagataattataaggaatataccttgcttatccaaacacattctcattctcctttgccataaataagttacttggcaaatatattgtatgtatttttaataaataaataaaatcttaaaaataaataaaattatttgtgaagacaaaaaaaataagttacttggaaaggatgaaggaaaatactggagctttgggtgtggtttagtagtagaacacttggctgatgtaaaaaaaaagccctaggtgcaatcccaacaccagaaacaaatgaaggaatgaacaacaaccgcccccaccccccaggggatgaatataaaaatatcaggtaatacagaactaacaggtgatccgtttcctatgaataactactgaacattcccagggaggtggcccactgataatatatttttatttattggttccttttaaacaagactgggaatatattatctagcttgcatcaccaccaccaccccccacccccgccccatgaagttatttcaaagaagaattttagtgttcatgtgattccctaaataaaatgatagtaaccttttacccaggttttcagatgtgtttggaggagttttctgtcttctgagggctggtcctctttccttttcagcgtttactatcacggctccaaaggacttgtacgtggtggagtatggcagcaacgtcacgatggagtgcagattccctgtagaacgggagctggacctgcttgcgttagtggtgtactgggaaaaggaagatgagcaagtgattcagtttgtggcaggagaggaggaccttaagcctcagcacagcaacttcagggggagagcctcgctgccaaaggaccagcttttgaagggaaatgctgcccttcagatcacagacgtcaagctgcaggacgcaggcgtttactgctgcataatcagctacggtggtgcggactacaagcgaatcacgctgaaagtcaatggtaagaattaccctggatggggaaggcttcatccgtatttaaaacagctccctaatgttgagagctcttcattcttgagagttcgcacgcacttctcacagaacaacagcagcctgttcttctcgctcgtttgttcattcgttcgttcacacacttcaccagtgaaaaagcctagcactgtgtgtttgatagtaacttgagattcagtaccagataatactcagccatgctttgcagtcagtaccatgatcttgcaaaggtgaaatgccaggtgtttgtttcttatcataaatgcaatatataatatattacatagatgtatagatataactgtgtaacatgcaataagatataatatgcatatatttcatataacataatgtataatatataatgtataataatatatactacaatatatagttatatgcatagttatatattgcatttatgataaaaagcaaacacctggcatttcacttttgcaagctttttgaattacttgtaaatatatatacatgcaaacatacatacacacacatgtttttttacaagtaatttgaatgtcatggaaagaaatagaatcataaaaatgtccctcctccctaactaccatcttctaagcataaatatacagtaactactatttgtacatccctccatgactttttgattggattactgtttatatttaatctatcaggcttagcacattttctttcctttgaatacctccatacaaaattcaatgtgtgtttatatatatatgtatatatatagttatatcatatcatatatcatacaaagttttatatatgtatacatatataaacacacatatctacacatacatacacattttttatatatatacacaatatataatgtatatgtgtgtgtgtgtgcatatacctctatatctatctatctatctatctatctatctatctatctatctatctatctatagcttctactgtaagggtcactttttaaaaaattaaggttaatctatgaaggatgagaagtgaagatcttaagtgtagaagaagccgttcttccacagagatggtacaggctacactcagcaggcatgcattcattttcagggcctgcatctctgggagtgctgaggaggaactatgagtgtaagttcctgggtaacgagccacagaaatgtcatcaggtcccttgagttcacggttctgggttggaactaactaagggaaggaaaacaccttgctaaccacccctgctttcactgttgggttgcatagacctgagagcttcactcatcgcaggcgtgcacacagccagcccagttgcccaccaggactggaaatccccaaggctctcctcttcacatacctcccacagtggtgtccctcgaatcaggtccctttcgtggtctgcggaaacttcaccttgatggacactgagccgaaccccgtcttctccaggcagacgttgcagatggtctgcctgctccttttcggttttcataataactttaaaactatttggctagaatcagatagtctccttcgatctttttactcctaaactagtgtgaagctcaatattatacataggaaaaattcacattcctcataagggatcacggcagttattaacgcaatcttatgtagagattaggaaaaatgtgtccattcgacagtttattaatgggtctgtgatggtgggtcgcttagagcttatgaagatgccacttgccttatttcggtgcttggctctaacttccattaccttttacttacaattcttcatttgtgacactcatgaaaggagactcgggatatggttgttaatatcttgagcagctgttagtacatcagcaaatatgaggctcctgtttggttccaagatttttaaagacattgtgaagctggaaggccatgagcagtcaaagttgctggacctggggcactggaaggagctcaaggcgggcagtcaggaagaagggagcagggtgtaagcctctgtgacaagaggtctctcatggcttgttaggagtaggtgactctggtaaggaggaatttactctagattatgtgctcagtgatatctctgataccaaagacaatcttttggagcgcacggcttctccacggagggacctgtgatgcggcaaagctggtatccaagcagtcttgaaggcctgcttgactattttgttttcttacagaaatcactacgtcgatattttactcccagttcaccttgccatttgcatgcacgttagctggtctaggccaagagtctgaaccttggttgtggctcaaatctgtaatctcagctatgtgggaagctgaggcaggagaatcgcgcaattaggacttgtctgagctacgaacatatagcaggttcaagagcagcctgggcaatttggcaagatccgttctcaaagacatacatacatacatatatttggcaagatccgttctcaaagacatacatacatacatacatttggcaagatccgttctcaaagacatacatacatgcatgcatgcataaatacatgtataaatgaatataaaattaaaataggaacaggactgaggacatgcccagtgatgtacaggaccctggtttcagtttctagcaccatggtcgctggcatgcaaaagctttccatgtcaaggaagtagaactcctgaattctgtgctatgcaaatgacttcacagcaaggttccttcccatcactgcaagtgtgtggtggtgaagcagccctacagggagttcactcgccatggggttttaaaggtgaattatttcaaaactgaaatctgaaagagtgtagttttggattaactcagtttttattatctctttggataatgttctaccttcaaaggtttacagaagaccctcaggcatcaggcttttaattgaaaaatattcagctttaatcactgacctcaatatcagaaaagaatgaagtgtccatttagtagtcctcggaccgtagatggcattaagcagctgtaagaaacacgctcatcacatggttcaacaattaaggattgccatggtgcacccgatcccccagctctgtttaaaccttttctctgtcatctatgcctatctaagatgtctcagcatatcatgcttattgtctctttccttctcttgaacacaagctctaggggtaggggctttggtcagttttattgttggacctgttggccttgacgtattatgaaggggcagtgtaataagaaaagaaaaccgtgtttgttgatggaatggtttaaaaaaaaattagcttaaaatgtatgctatacgaacgggcatgaatctgggagattttagactgttccttgtgagccgtaggaactttcttgtttctgtgttcacagtcctccgcagctgtgctcatggtcctccacatctgcctaacaacagcaggggtagatgttataattaacactcacagaacacctgatatgtgagaggttgtgccctgggcttcttgctcatatgaattcatttcatctttaacataactcttcgggggaggcacttgcccatgaccatggcttgttttctttcctatcgactatctttcaaatcggaatgtgtctttccctaggtgacatctcagattcaatgttacacagcactgctgtgcccattttcaggcattaaaaatgcgatccgcctaaattccaccccgataaaattatgcagccaggttcggaacccaactagcccatctctaaaaatctatgcccttcctagcctcgctttgttgcctgtctttgtacctctggagtgggtatcaaggaacagaatggctttaaacatgatttgaacttttcctggtttttgatcacagcagtaacagagtgttctagagataagccagaggtttgaaaacaaacagaacttgtctttgaggtgttataaacatgtgtgtgattataaaggatatatctggtgccaataggtatagcttatattataagaaatggccattgtgaagatcagaaggagataactcactgatttcaggtggttgattcaatctaacacatgatatattctgaaactgtacaaaaaagatattcaaaagaagaaacacatggaacaaagagtatatggaaattctgacaactcagaatcagtgtatgttaagatgaagttcatgattaacaaatggagatggtcgcagtcatcctgaagcttattttagccaatgctttatcacatccaactcaatcttcgttttttttttttcagatggatcttcccatttttaattaaccttatcatgatagcccctagtaaggcatgtcctgacatttcttttctttttttttatagcttatgtttctttttttaaaaatttttttactacatattttcctcaattacatttccaatgctatcccaaaagtcccccataccctcctcccccactcccctacccacccactcccactttttggccctggggttcccctgtactgggggatataaagtctgcgtgtccaatgggcctctctttccagtgatggcctactaggccatcttttgatacatatgcagcttgagtcaagagctccggggtactggttagttcatagtgttgttccacctatagggttgcagatccctttagttccttgggtgctttctctagcttctccattgggagccctgtgatccatccaatagctgactgtgagcatccacttctgtgtttgctaggtcccggccaagtctcacaagagacagctatttcagggtcctttcagcatatgcttgctagtgtatgcaatggtgtcatcgtttggaggctaattatgggatggctccctggatatggcagtctctaaatggtccatccttttgtctcagctccaaactttgtctctgtaactcctttcaatcttcgtttttaatgtccgaaaatgactggtaacgtcactgcttacatttccctttgctttgtgttgaattgtgagctttatctttgatctggagtttctttaagaagactttgtaatgtgcttatttttaaagatggtgaattcaattaaagatagacaagagggacgggtctgtatttcatctggtagagtgcttacctgccattcatgaagttctggttcgatccccggcacagcatagaaccacatgcggtggcaactcagttgcctgtgaccccagcactcaggagctagaggcaggttacctttgactacacagcaagttcaaggctagcctggtctacatgcaactcttcctcaaagggaaaacaaaacaaaaatagacaggagaattggaaacatccatagaaacccaaatatgaatcaatagactcccctcttcctgtgtcagacattcagactcagtgacagccgtcaccgtttatgaggcatgactgattttacagatcctagagcaagcgtgcacaattctggtgtttcctgcctgcgtcctcacacacacgctcaccttagggacggaggcagcggaggtctagtcagtttcagacgaatccactcatcagctgctcaccatggtcttctaggtgaagcagaactctccttccatcagcacccgtgaaaaacaaaagtggaaagcagatatttcactccgaatgctttatcattggcagtgatttcaaatttaaaccactaatttcccagaagaattaggtcacgggccatgtggcattagaccctattgtggtgacattatttcctgatgtgcctatttaataatgtatagtggtctcatctttatttagttggtcttgaatgtgataaatacaagactgggcaagtgttcatcaaagctgttacttgaaattgtaattatacctattttgttggtggtgttttttcttggttcatggacaaccaaacacattacggctttgctttgtcttagctactctgtgtcaagttcctgtgaaaataccgtattacagtgctcttattacatctttggtaatgaagtagtcacctaagcccctatcctgggctctctatggctcactaaagaatcgtaagttggataatgattgctgaagaaatagatatgttttatttacattgaggtagaaagacctgtggtttctaggtaacagtttacttaacttagttgctacatctagtttgcactcagtaaacaccctggtgtggtttttacaacaacaaggttgttcctgaagcccaaacatggcccagatttgaatagaagacctgaggcagactaacactcactccctgctgccaaagtagcagagccggggacatatttctccaatagccagcccgagttgatgctctttgtaagcagacaccacaaagccacacggctagccctaagatgggagagccctgacctctctttgcttctgacctagccccataccgcaaaatcaaccagagaatttccgtggatccagccacttctgagcatgaactaatatgtcaggccgagggttatccagaagctgaggtaatctggacaaacagtgaccaccaacccgtgagtgggaagagaagtgtcaccacttcccggacagaggggatgcttctcaatgtgaccagcagtctgagggtcaacgccacagcgaatgatgttttctactgtacgttttggagatcacagccagggcaaaaccacacagcggagctgatcatcccaggtgagttgcctaactcgtccccggattcctagcacgatggccatccgccatagtcatttagcagtagttggccgagtgtatgaatacatgaaacttacattggctagacgtattctagttcctctttctcttgcgtgcaagccataatgctacttggtcaacactcagcaagaattaagtgtttgctcctgacagacagtatgttagtcattgagtattcgtggctggataggacataagttactctgctccaggaaacaggtgacagtcgcatgtaggagatgctcttgtaacttgggcaccacgggcaacgtgagagcaagcttatgcttcaggaatgtaaacctttgtcacatcaaagctgccctcttccctcccgggctgctgtagtagaaagcaaatgcattgcctttttttgtatcttatattcaacaggaagaatcctttcttcccatactcctcttcagggcattccctgatacttcaactccaggaagtctgcctgtgcatagaacacgaggctgatgcctatgggcaaccgactagctgggttgtaactcaccaggccagggcattgtagggatagaatgagctgcacgaaaatgattgtaggaaaatcgtttgagaattcagctgtctttaaaattcatttaccttacagaaatagggccacaggagacagtttggtgagaggctcagagcattatatgaatatgaacccagaggtactcactctgaggagggttgcttctgcctccatcgacacccctttcccaatgtatgtcaacagtacattgatgtctagagatagctctgtgaagtttagagaagatatataaaactacattaaaaagtcaaccaatatgaaaaatgaagcccaggatgggcgtggagccaaaaggagcacacaagtttggaaaaatgtaaaataaaaaggaagacactctaactagaattggacttttccataaaagctatattgttggtttcctaccattaaatgttttatggggctggagacgttgtagctcagttgggagagtacttgcctagcatccacaatgctctgaccccagcgccatataaacgtatatagggctcacctatagtctaaacactttggtggtggaagccggagggtcagttcaaggtcatcctcagcttcatagcaagttcaaggccagtatggactgactacaagagaccctgcctcaaagacaaaacaagcaaacatcatcataataaaacagcaaaaagctgttctctggccatttctttgtaggacatcctggagtaacttaaccactctgagtgtctcttctcatctgtaacttgggttcatagtgggaccaaataggagctgagttacaacaggagatggaagttagcaatctcagagcatcccagagccctgggacccatttttctctttctcaaaactccaggcagagaaacagggagatgttaatgactggagtgcccaagagtctcagacatggaagaaacacaacccgcactggtccacatttgtgggagacagaagcggcttagcagtgccccgctttcccatgttcgggagttggccttccacaccaagtcagccattactgtctatattaatgagtgcacaaggaagttactgcactaaggttaccatttaatattgcagtcactttctgtggcaacatgtcacaggcctggagttcttctctgtgctgctcccagtttcttaggagatctgtcttcttcttccaacccttacctggacattaactttcagtgattaagattaccctaagaccaaactatatttcaggagtcatcattcccctgactatggcgcagcaaagccttaccttccatcagcttctctttatccttttccagaactgcctgcaacacatcctccacagaacaggactcactgggtgcttctgggatccatcctgttgttcctcattgtagtgtccacggtcctcctcttcttgagaaaacaaggtatttcctccattgctgtactgcctgcagggaagtgcatgagggtcccttcaccattgccttgagcaggcagtgccagagatggtaccaccctgacaagaacagacccacatcacagggcgtcctacactgcacgctagctgaacctcaccaggaaacactgacttgaaaggtgctgccctccattccctgggcttgctttcagttacacagagtaagttttaacagtgactctggtgtactgagtcttccttaagtcctgttcacattgttgctctgcgacatctcctaccttggagctcggtgttggaccctgttgtaatatgaagaggtatcagttggacaagggcgtagggaagctaaaagacttagctttcaaggcgtgggggagggggagggcattgtgaggttccctgttcagcggttcagagtaaagctgggcagcacacaagtttagacaacaaggaagatgctctaactggggttggaggtcaatggtgcagggataggtagcaatggaggctaaagaagaaagccataaggtttctttctacagactctgaagacagagcactgtggtgcctattggtctcaggtgaactcaagtcttgtgttccttacaccacctattgagctgggttctggataccctaagtggaaaaacacttctgtctaaaaagagctgtggcatctttaccacaaagcactttttttttttgcaagatttctgaagacgaaatgacacagtttttaaaataatttccatatatttatttcagtacttacccataagaatgactgaaatctaggaaaatgaatatattcaaataatgccttcctattgtaaagtgacttagagtaaaccttttcaccaaatactttgaaatgcataccaagtgagccaatgatgcatggacttgtgtgaagccaaatggggaaatagaatatgggagggaacatcaatcatcagagaggaattccccatcacccttttggagggcgcgtgtatgggaaaagtgttgtaactggggcggtagcgaccagctgcttccaaagaataagccctgagcagaaccaagagggttgccagggtgtgaagattaagcttcagagacacatctggcttagggctagcctaggacttgcacaggaccgcagttgttgcctaatggcatctgggatgattggctgaggatgaggaaagcagagagtcagttaggtggtaagctagctcaggatgtgggacgtttctgagggaagggtggaagacaaagtagacagtcctaaaaaccatctgagaatgaaagtatgtaccctaaattgttgaataattaactttgcggcgtgggatctggaataaggaagttcacgggctaaaagcctggtgattaggggattgatcggtgtctcctaaaaaccttaagttgaaaatcgagtccctgtgggttgtagtagcatcttgctataaggaattaagattgatttcttcttctttagtgagaatgctagatgtggagaaatgtggcgttgaagatacaagctcaaaaaaccgaaatggtaagtgtgagtaacgagggaggggcaagccgagggaatgagtgggacagagcagccaagcagggtcctgcaagggctgcagttccagcgctctgtaggctgaggcagggggatagggagttccaggccagcaaccacacagccaaaacaaaacaaacaaaacaaaaaacaaagcaaaaggaagagcagaaaaagctactgttaccaacaagagacatactttagccgtgatctcctctccttccaaaggaagctgtttgtgggggctgctggttcctctgcctaaggatcgccacatctgagaaaactctgggtttgctgctgcggtgtctgtgtggtagccctgcaaccagggacgctgttgacttatttgaatgggcatttgattaagcaaatgattctgctgtgtggttagctgttaactgtttcatgtgtatgatatggcatttcatttcatcatcctgcccccaatcagataaatatgagaatcatctccattgtatagtagggaaaacagggctgagaagataatgcgaggtgcctaagaacacacagacttgctaccacagacgtccgttctttgctaggtgcttcaatctatgctgctactaatgtctgtatttataagagtagaaaactctgcccgggcgttggtggcccacgcctttaatcccagcactcgggaggcagaggtagtcggatttctgagtttgaggccagcctggtctacagagtgagttccaggacagccaggctacacagagaaaccctgtctcgaaaaaaatcaaaaaagaaaaaagaacaagaaaactctaactgaactatcttgtagtaaattacagtgtgttctaattcattttagtgttgttagaaaccaaacagtaaggccaggcagaactaaagtggtttcgctaacttgggcagacccaagcaggttccctcctgtacattaccatttattctgctgagtcaccctgaggaaccggcctggcttgctcaagactgaggatttctcagccatgaacactttccattttaaaactagggcagtcccggacaagcaaggatggttagtcatccttcatcatgtaagggtagtcagacataggtagtatctgtctctgtcttacggcaacgttactatctgctctagcaaacatcccatttgtttatcttacatatcatacgtttcccccccacatattccctgcccctgtgaaattattatactatgatcactctccagatacacaattcgaggagacgtaagcagtgttgaaccctctgatcgtcgattggcagcttgtggtctgtgaaagaaagggcccatgggacatgagtccaaagactcaagatggaacctgagggagagaaccaagaaagtgttgggagaggagcctggaacaacggacattttttccagggagacactgctaagcaagttgcccatcagtcgtcttgggaaatggattgagggttcctggcttagcagctggtccttgcacagtgaccttttcctctgctcagtgccgggatgagagatggagtcatgagtgttgaagaataagtgccttctatttattttgagtctgtgtgttctcactttgggcatgtaattatgactggtgaattctgacgacatgatagatcttaagatgtagtcaccaaactcaactgctgcttagcatcctccgtaactactgatacaagcagggaacacagaggtcacctgcttggtttgacaggctcttgctgtctgactcaaataatctttatttttcagtcctcaaggctcttcgatagcagttgttctgtatcagccttataggtgtcaggtatagcactcaacatctcatctcattacaatagcaaccctcatcaccatagcaacagctaacctctgttatcctcacttcatagccaggaagctgagcgactaagtcacttgcccacagagtatcagctctcagatttctgttcttcagccactgtcctttcaggatagaatttgtcgttaagaaattaatttaaaaactgattattgagtagcattgtatatcaatcacaacatgccttgtgcactgtgctggcctctgagcataaagatgtacgccggagtaccggtcggacatgtttatgtgtgttaaatactcagagaaatgttcattaacaaggagcttgcattttagagacactggaaagtaactccagttcattgtctagcattacatttacctcatttgctatccttgccatacagtctcttgttctccatgaagtgtcatgaatcttgttgaatagttcttttattttttaaatgtttctatttaaatgatattgacatctgaggcgatagctcagttggtaaaaccctttcctcacaagtgtgaaaccctgagtcttatccctagaacccacataaaaaacagttgcgtatgtttgtgcatgcttttgatcccagcactagggaggcagaggcaggcagatcctgagctctcattgaccacccagcctagcctacatggttagctccaggcctacaggagctggcagagcctgaaaaacgatgcctagacacacacacacacacacacacacacacacacacacacacacaccatgtactcatagacctaagtgcaccctcctacacatgcacacacatacaattcaaacacaaatcaacagggaattgtctcagaatggtccccaagacaaagaagaagaaaaacaccaaaccagctctattccctcagcctatcctctctactccttcctagaagcaactactattgtttttgtatataaatttacccaacgacagttaatatgtagaatatatattaaagtgtctgtcaatatatattatctctttctttctttcttcctttctttctttctttctttctttctttctttctttctttctttctttcttccttccttccttccttccttccttccttccttcctttctttctttctttctttttttctgtctatctgtacctaaatggttgctcactatgcattttctgtgctcttcgccctttttatttaatgtatggatatttatgctgcttccagaatggatctaaagctctttgtttctaggttttctcccccatccttctaggcatctctcacactgtctaggccagacaccatgtctgctgcctgaatctgtagacaccatttataaagcacgtactcaccgagtttgtatttggcttgttctgtgtctgattaaagggagaccatgagtccccagggtacactgagttaccccagtaccaagggggagccttgtttgtgtctccatggcagaagcaggcctggagccattttggtttcttccttgacttctctcaaacacagacgcctcacttgctcattacaggttctcctttgggaatgtcagcattgctccttgactgctggctgccctggaaggagcccattagctctgtgtgagcccttgacagctactgcctctccttaccacaggggcctctaagatactgttacctagaggtcttgaggatctgtgttctctggggggaggaaaggaggaggaacccagaactttcttacagttttccttgttctgtcacatgtcaagactgaaggaacaggctgggctacgtagtgagatcctgtctcaaaggaaagacgagcatagccgaacccccggtggaaccccctctgttacctgttcacacaagcttattgatgagtctcatgttaatgtcttgtttgtatgaagtttaagaaaatatcgggttgggcaacacattctatttattcattttatttgaaatcttaatgccatctcatggtgttggattggtgtggcactttattcttttgtgttgtgtataaccataaattttattttgcatcagattgtcaatgtattgcattaatttaataaatatttttatttattaaa

SEQ ID NO: 5 - DNA, 16 bp, synthetic construct
  misc_feature 1..16: note = Oligonucleotide motif
  source 1..16: mol_type = other DNA
taattggctctactgc

SEQ ID NO: 6 - DNA, 16 bp, synthetic construct
  misc_feature 1..16: note = Oligonucleotide motif
  source 1..16: mol_type = other DNA
tcgcataagaatgact

SEQ ID NO: 7 - DNA, 16 bp, synthetic construct
  misc_feature 1..16: note = Oligonucleotide motif
  source 1..16: mol_type = other DNA
tgaacacacagtcgca

SEQ ID NO: 8 - DNA, 16 bp, synthetic construct
  misc_feature 1..16: note = Oligonucleotide motif
  source 1..16: mol_type = other DNA
ctgaacacacagtcgc

SEQ ID NO: 9 - DNA, 16 bp, synthetic construct
  misc_feature 1..16: note = Oligonucleotide motif
  source 1..16: mol_type = other DNA
tctgaacacacagtcg

SEQ ID NO: 10 - DNA, 16 bp, synthetic construct
  misc_feature 1..16: note = Oligonucleotide motif
  source 1..16: mol_type = other DNA
ttctgaacacacagtc

SEQ ID NO: 11 - DNA, 16 bp, synthetic construct
  misc_feature 1..16: note = Oligonucleotide motif
  source 1..16: mol_type = other DNA
acaagtcatgttacta

SEQ ID NO: 12 - DNA, 16 bp, synthetic construct
  misc_feature 1..16: note = Oligonucleotide motif
  source 1..16: mol_type = other DNA
acacaagtcatgttac

SEQ ID NO: 13 - DNA, 16 bp, synthetic construct
  misc_feature 1..16: note = Oligonucleotide motif
  source 1..16: mol_type = other DNA
cttacttagatgctgc

SEQ ID NO: 14 - DNA, 16 bp, synthetic construct
  misc_feature 1..16: note = Oligonucleotide motif
  source 1..16: mol_type = other DNA
acttacttagatgctg

SEQ ID NO: 15 - DNA, 16 bp, synthetic construct
  misc_feature 1..16: note = Oligonucleotide motif
  source 1..16: mol_type = other DNA
gacttacttagatgct

SEQ ID NO: 16 - DNA, 16 bp, synthetic construct
  misc_feature 1..16: note = Oligonucleotide motif
  source 1..16: mol_type = other DNA
agacttacttagatgc

SEQ ID NO: 17 - DNA, 16 bp, synthetic construct
  misc_feature 1..16: note = Oligonucleotide motif
  source 1..16: mol_type = other DNA
gcaggaagagacttac

SEQ ID NO: 18 - DNA, 17 bp, synthetic construct
  misc_feature 1..17: note = Oligonucleotide motif
  source 1..17: mol_type = other DNA
aataaattccgttcagg

SEQ ID NO: 19 - DNA, 16 bp, synthetic construct
  misc_feature 1..16: note = Oligonucleotide motif
  source 1..16: mol_type = other DNA
gcaaataaattccgtt

SEQ ID NO: 20 - DNA, 16 bp, synthetic construct
  misc_feature 1..16: note = Oligonucleotide motif
  source 1..16: mol_type = other DNA
agcaaataaattccgt

SEQ ID NO: 21 - DNA, 17 bp, synthetic construct
  misc_feature 1..17: note = Oligonucleotide motif
  source 1..17: mol_type = other DNA
cagagcaaataaattcc

SEQ ID NO: 22 - DNA, 18 bp, synthetic construct
  misc_feature 1..18: note = Oligonucleotide motif
  source 1..18: mol_type = other DNA
tggacagagcaaataaat

SEQ ID NO: 23 - DNA, 16 bp, synthetic construct
  misc_feature 1..16: note = Oligonucleotide motif
  source 1..16: mol_type = other DNA
atggacagagcaaata

SEQ ID NO: 24 - DNA, 16 bp, synthetic construct
  misc_feature 1..16: note = Oligonucleotide motif
  source 1..16: mol_type = other DNA
cagaatggacagagca

SEQ ID NO: 25 - DNA, 16 bp, synthetic construct
  misc_feature 1..16: note = Oligonucleotide motif
  source 1..16: mol_type = other DNA
ttctcagaatggacag

SEQ ID NO: 26 - DNA, 16 bp, synthetic construct
  misc_feature 1..16: note = Oligonucleotide motif
  source 1..16: mol_type = other DNA
ctgaactttgacatag

SEQ ID NO: 27 - DNA, 18 bp, synthetic construct
  misc_feature 1..18: note = Oligonucleotide motif
  source 1..18: mol_type = other DNA
aagacaaacccagactga

SEQ ID NO: 28 - DNA, 18 bp, synthetic construct
  misc_feature 1..18: note = Oligonucleotide motif
  source 1..18: mol_type = other DNA
tataagacaaacccagac

SEQ ID NO: 29 - DNA, 18 bp, synthetic construct
  misc_feature 1..18: note = Oligonucleotide motif
  source 1..18: mol_type = other DNA
ttataagacaaacccaga

SEQ ID NO: 30 - DNA, 17 bp, synthetic construct
  misc_feature 1..17: note = Oligonucleotide motif
  source 1..17: mol_type = other DNA
tgttataagacaaaccc

SEQ ID NO: 31 - DNA, 17 bp, synthetic construct
  misc_feature 1..17: note = Oligonucleotide motif
  source 1..17: mol_type = other DNA
tagaacaatggtacttt

SEQ ID NO: 32 - DNA, 16 bp, synthetic construct
  misc_feature 1..16: note = Oligonucleotide motif
  source 1..16: mol_type = other DNA
gtagaacaatggtact

SEQ ID NO: 33 - DNA, 16 bp, synthetic construct
  misc_feature 1..16: note = Oligonucleotide motif
  source 1..16: mol_type = other DNA
aggtagaacaatggta

SEQ ID NO: 34 - DNA, 17 bp, synthetic construct
  misc_feature 1..17: note = Oligonucleotide motif
  source 1..17: mol_type = other DNA
aagaggtagaacaatgg

SEQ ID NO: 35 - DNA, 16 bp, synthetic construct
  misc_feature 1..16: note = Oligonucleotide motif
  source 1..16: mol_type = other DNA
gcatccacagtaaatt

SEQ ID NO: 36 - DNA, 16 bp, synthetic construct
  misc_feature 1..16: note = Oligonucleotide motif
  source 1..16: mol_type = other DNA
gaaggttatttaattc

SEQ ID NO: 37 - DNA, 16 bp, synthetic construct
  misc_feature 1..16: note = Oligonucleotide motif
  source 1..16: mol_type = other DNA
ctaatcgaatgcagca

SEQ ID NO: 38 - DNA, 16 bp, synthetic construct
  misc_feature 1..16: note = Oligonucleotide motif
  source 1..16: mol_type = other DNA
tacccaatctaatcga

SEQ ID NO: 39 - DNA, 16 bp, synthetic construct
  misc_feature 1..16: note = Oligonucleotide motif
  source 1..16: mol_type = other DNA
tagttacccaatctaa

SEQ ID NO: 40 - DNA, 16 bp, synthetic construct
  misc_feature 1..16: note = Oligonucleotide motif
  source 1..16: mol_type = other DNA
catttagttacccaat

SEQ ID NO: 41 - DNA, 16 bp, synthetic construct
  misc_feature 1..16: note = Oligonucleotide motif
  source 1..16: mol_type = other DNA
tcatttagttacccaa

SEQ ID NO: 42 - DNA, 16 bp, synthetic construct
  misc_feature 1..16: note = Oligonucleotide motif
  source 1..16: mol_type = other DNA
ttcatttagttaccca

SEQ ID NO: 43 - DNA, 18 bp, synthetic construct
  misc_feature 1..18: note = Oligonucleotide motif
  source 1..18: mol_type = other DNA
gaattaatttcatttagt

SEQ ID NO: 44 - DNA, 17 bp, synthetic construct
  misc_feature 1..17: note = Oligonucleotide motif
  source 1..17: mol_type = other DNA
cagtgaggaattaattt

SEQ ID NO: 45 - DNA, 16 bp, synthetic construct
  misc_feature 1..16: note = Oligonucleotide motif
  source 1..16: mol_type = other DNA
ccaacagtgaggaatt

SEQ ID NO: 46 - DNA, 16 bp, synthetic construct
  misc_feature 1..16: note = Oligonucleotide motif
  source 1..16: mol_type = other DNA
cccaacagtgaggaat

SEQ ID NO: 47 - DNA, 17 bp, synthetic construct
  misc_feature 1..17: note = Oligonucleotide motif
  source 1..17: mol_type = other DNA
tatacccaacagtgagg

SEQ ID NO: 48 - DNA, 17 bp, synthetic construct
  misc_feature 1..17: note = Oligonucleotide motif
  source 1..17: mol_type = other DNA
ttatacccaacagtgag

SEQ ID NO: 49 - DNA, 17 bp, synthetic construct
  misc_feature 1..17: note = Oligonucleotide motif
  source 1..17: mol_type = other DNA
tttatacccaacagtga

SEQ ID NO: 50 - DNA, 16 bp, synthetic construct
  misc_feature 1..16: note = Oligonucleotide motif
  source 1..16: mol_type = other DNA
cctttatacccaacag

SEQ ID NO: 51 - DNA, 16 bp, synthetic construct
  misc_feature 1..16: note = Oligonucleotide motif
  source 1..16: mol_type = other DNA
taacctttatacccaa

SEQ ID NO: 52 - DNA, 17 bp, synthetic construct
  misc_feature 1..17: note = Oligonucleotide motif
  source 1..17: mol_type = other DNA
aataacctttataccca

SEQ ID NO: 53 - DNA, 16 bp, synthetic construct
  misc_feature 1..16: note = Oligonucleotide motif
  source 1..16: mol_type = other DNA
gtaaataacctttata

SEQ ID NO: 54 - DNA, 18 bp, synthetic construct
  misc_feature 1..18: note = Oligonucleotide motif
  source 1..18: mol_type = other DNA
actgtaaataacctttat

SEQ ID NO: 55 - DNA, 16 bp, synthetic construct
  misc_feature 1..16: note = Oligonucleotide motif
  source 1..16: mol_type = other DNA
atatatatgcaatgag

SEQ ID NO: 56 - DNA, 16 bp, synthetic construct
  misc_feature 1..16: note = Oligonucleotide motif
  source 1..16: mol_type = other DNA
agatatatatgcaatg

SEQ ID NO: 57 - DNA, 16 bp, synthetic construct
  misc_feature 1..16: note = Oligonucleotide motif
  source 1..16: mol_type = other DNA
gagatatatatgcaat

SEQ ID NO: 58 - DNA, 16 bp, synthetic construct
  misc_feature 1..16: note = Oligonucleotide motif
  source 1..16: mol_type = other DNA
ccagagatatatatgc

SEQ ID NO: 59 - DNA, 17 bp, synthetic construct
  misc_feature 1..17: note = Oligonucleotide motif
  source 1..17: mol_type = other DNA
caatattccagagatat

SEQ ID NO: 60 - DNA, 17 bp, synthetic construct
  misc_feature 1..17: note = Oligonucleotide motif
  source 1..17: mol_type = other DNA
gcaatattccagagata

SEQ ID NO: 61 - DNA, 17 bp, synthetic construct
  misc_feature 1..17: note = Oligonucleotide motif
  source 1..17: mol_type = other DNA
agcaatattccagagat

SEQ ID NO: 62 - DNA, 16 bp, synthetic construct
  misc_feature 1..16: note = Oligonucleotide motif
  source 1..16: mol_type = other DNA
cagcaatattccagag

SEQ ID NO: 63 - DNA, 17 bp, synthetic construct
  misc_feature 1..17: note = Oligonucleotide motif
  source 1..17: mol_type = other DNA
aatcagcaatattccag

SEQ ID NO: 64 - DNA, 17 bp, synthetic construct
  misc_feature 1..17: note = Oligonucleotide motif
  source 1..17: mol_type = other DNA
acaatcagcaatattcc

SEQ ID NO: 65 - DNA, 19 bp, synthetic construct
  misc_feature 1..19: note = Oligonucleotide motif
  source 1..19: mol_type = other DNA
actaagtagttacacttct

SEQ ID NO: 66 - DNA, 17 bp, synthetic construct
  misc_feature 1..17: note = Oligonucleotide motif
  source 1..17: mol_type = other DNA
ctaagtagttacacttc

SEQ ID NO: 67 - DNA, 18 bp, synthetic construct
  misc_feature 1..18: note = Oligonucleotide motif
  source 1..18: mol_type = other DNA
gactaagtagttacactt

SEQ ID NO: 68 - DNA, 16 bp, synthetic construct
  misc_feature 1..16: note = Oligonucleotide motif
  source 1..16: mol_type = other DNA
tgactaagtagttaca

SEQ ID NO: 69 - DNA, 17 bp, synthetic construct
  misc_feature 1..17: note = Oligonucleotide motif
  source 1..17: mol_type = other DNA
ctttgactaagtagtta

SEQ ID NO: 70 - DNA, 16 bp, synthetic construct
  misc_feature 1..16: note = Oligonucleotide motif
  source 1..16: mol_type = other DNA
ctctttgactaagtag

SEQ ID NO: 71 - DNA, 16 bp, synthetic construct
  misc_feature 1..16: note = Oligonucleotide motif
  source 1..16: mol_type = other DNA
gctctttgactaagta

SEQ ID NO: 72 - DNA, 17 bp, synthetic construct
  misc_feature 1..17: note = Oligonucleotide motif
  source 1..17: mol_type = other DNA
ccttaaatactgttgac

SEQ ID NO: 73 - DNA, 16 bp, synthetic construct
  misc_feature 1..16: note = Oligonucleotide motif
  source 1..16: mol_type = other DNA
cttaaatactgttgac

SEQ ID NO: 74 - DNA, 16 bp, synthetic construct
  misc_feature 1..16: note = Oligonucleotide motif
  source 1..16: mol_type = other DNA
tccttaaatactgttg

SEQ ID NO: 75 - DNA, 17 bp, synthetic construct
  misc_feature 1..17: note = Oligonucleotide motif
  source 1..17: mol_type = other DNA
tctccttaaatactgtt

SEQ ID NO: 76 - DNA, 16 bp, synthetic construct
  misc_feature 1..16: note = Oligonucleotide motif
  source 1..16: mol_type = other DNA
tatcatagttctcctt

SEQ ID NO: 77 - DNA, 16 bp, synthetic construct
  misc_feature 1..16: note = Oligonucleotide motif
  source 1..16: mol_type = other DNA
agtatcatagttctcc

SEQ ID NO: 78 - DNA, 16 bp, synthetic construct
  misc_feature 1..16: note = Oligonucleotide motif
  source 1..16: mol_type = other DNA
gagtatcatagttctc

SEQ ID NO: 79 - DNA, 16 bp, synthetic construct
  misc_feature 1..16: note = Oligonucleotide motif
  source 1..16: mol_type = other DNA
agagtatcatagttct

SEQ ID NO: 80 - DNA, 16 bp, synthetic construct
  misc_feature 1..16: note = Oligonucleotide motif
  source 1..16: mol_type = other DNA
cagagtatcatagttc

SEQ ID NO: 81 - DNA, 16 bp, synthetic construct
  misc_feature 1..16: note = Oligonucleotide motif
  source 1..16: mol_type = other DNA
ttcagagtatcatagt

SEQ ID NO: 82 - DNA, 16 bp, synthetic construct
  misc_feature 1..16: note = Oligonucleotide motif
  source 1..16: mol_type = other DNA
cttcagagtatcatag

SEQ ID NO: 83 - DNA, 17 bp, synthetic construct
  misc_feature 1..17: note = Oligonucleotide motif
  source 1..17: mol_type = other DNA
ttcttcagagtatcata

SEQ ID NO: 84 - DNA, 17 bp, synthetic construct
  misc_feature 1..17: note = Oligonucleotide motif
  source 1..17: mol_type = other DNA
tttcttcagagtatcat

SEQ ID NO: 85 - DNA, 16 bp, synthetic construct
  misc_feature 1..16: note = Oligonucleotide motif
  source 1..16: mol_type = other DNA
gagaaaggctaagttt

SEQ ID NO: 86 - DNA, 16 bp, synthetic construct
  misc_feature 1..16: note = Oligonucleotide motif
  source 1..16: mol_type = other DNA
gacactcttgtacatt

SEQ ID NO: 87 - DNA, 17 bp, synthetic construct
  misc_feature 1..17: note = Oligonucleotide motif
  source 1..17: mol_type = other DNA
tgagacactcttgtaca

SEQ ID NO: 88 - DNA, 16 bp, synthetic construct
  misc_feature 1..16: note = Oligonucleotide motif
  source 1..16: mol_type = other DNA
tgagacactcttgtac

SEQ ID NO: 89 - DNA, 16 bp, synthetic construct
  misc_feature 1..16: note = Oligonucleotide motif
  source 1..16: mol_type = other DNA
ctttattaaactccat

SEQ ID NO: 90 - DNA, 16 bp, synthetic construct
  misc_feature 1..16: note = Oligonucleotide motif
  source 1..16: mol_type = other DNA
accaaactttattaaa

SEQ ID NO: 91 - DNA, 16 bp, synthetic construct
  misc_feature 1..16: note = Oligonucleotide motif
  source 1..16: mol_type = other DNA
aaacctctactaagtg

SEQ ID NO: 92 - DNA, 16 bp, synthetic construct
  misc_feature 1..16: note = Oligonucleotide motif
  source 1..16: mol_type = other DNA
agattaagacagttga

SEQ ID NO: 93 - DNA, 17 bp, synthetic construct
  misc_feature 1..17: note = Oligonucleotide motif
  source 1..17: mol_type = other DNA
aagtaggagcaagaggc

SEQ ID NO: 94 - DNA, 17 bp, synthetic construct
  misc_feature 1..17: note = Oligonucleotide motif
  source 1..17: mol_type = other DNA
aaagtaggagcaagagg

SEQ ID NO: 95 - DNA, 16 bp, synthetic construct
  misc_feature 1..16: note = Oligonucleotide motif
  source 1..16: mol_type = other DNA
gttaagcagccaggag

SEQ ID NO: 96 - DNA, 16 bp, synthetic construct
  misc_feature 1..16: note = Oligonucleotide motif
  source 1..16: mol_type = other DNA
agggtaggatgggtag

SEQ ID NO: 97 - DNA, 16 bp, synthetic construct
  misc_feature 1..16: note = Oligonucleotide motif
  source 1..16: mol_type = other DNA
aagggtaggatgggta

SEQ ID NO: 98 - DNA, 16 bp, synthetic construct
  misc_feature 1..16: note = Oligonucleotide motif
  source 1..16: mol_type = other DNA
caagggtaggatgggt

SEQ ID NO: 99 - DNA, 16 bp, synthetic construct
  misc_feature 1..16: note = Oligonucleotide motif
  source 1..16: mol_type = other DNA
ccaagggtaggatggg

SEQ ID NO: 100 - DNA, 16 bp, synthetic construct
  misc_feature 1..16: note = Oligonucleotide motif
  source 1..16: mol_type = other DNA
tccaagggtaggatgg

SEQ ID NO: 101 - DNA, 16 bp, synthetic construct
  misc_feature 1..16: note = Oligonucleotide motif
  source 1..16: mol_type = other DNA
cttccaagggtaggat

SEQ ID NO: 102 - DNA, 17 bp, synthetic construct
  misc_feature 1..17: note = Oligonucleotide motif
  source 1..17: mol_type = other DNA
atcttccaagggtagga

SEQ ID NO: 103 - DNA, 17 bp, synthetic construct
  misc_feature 1..17: note = Oligonucleotide motif
  source 1..17: mol_type = other DNA
agaagtgatggctcatt

SEQ ID NO: 104 - DNA, 17 bp, synthetic construct
  misc_feature 1..17: note = Oligonucleotide motif
  source 1..17: mol_type = other DNA
aagaagtgatggctcat

SEQ ID NO: 105 - DNA, 17 bp, synthetic construct
  misc_feature 1..17: note = Oligonucleotide motif
  source 1..17: mol_type = other DNA
gaagaagtgatggctca

SEQ ID NO: 106 - DNA, 17 bp, synthetic construct
  misc_feature 1..17: note = Oligonucleotide motif
  source 1..17: mol_type = other DNA
atgaaatgtaaactggg

SEQ ID NO: 107 - DNA, 18 bp, synthetic construct
  misc_feature 1..18: note = Oligonucleotide motif
  source 1..18: mol_type = other DNA
caatgaaatgtaaactgg

SEQ ID NO: 108 - DNA, 18 bp, synthetic construct
  misc_feature 1..18: note = Oligonucleotide motif
  source 1..18: mol_type = other DNA
gcaatgaaatgtaaactg

SEQ ID NO: 109 - DNA, 18 bp, synthetic construct
  misc_feature 1..18: note = Oligonucleotide motif
  source 1..18: mol_type = other DNA
agcaatgaaatgtaaact

SEQ ID NO: 110 - DNA, 18 bp, synthetic construct
  misc_feature 1..18: note = Oligonucleotide motif
  source 1..18: mol_type = other DNA
gagcaatgaaatgtaaac

SEQ ID NO: 111 - DNA, 17 bp, synthetic construct
  misc_feature 1..17: note = Oligonucleotide motif
  source 1..17: mol_type = other DNA
tgaattcccatatccga

SEQ ID NO: 112 - DNA, 16 bp, synthetic construct
  misc_feature 1..16: note = Oligonucleotide motif
  source 1..16: mol_type = other DNA
agaattatgaccatat

SEQ ID NO: 113 - DNA, 17 bp, synthetic construct
  misc_feature 1..17: note = Oligonucleotide motif
  source 1..17: mol_type = other DNA
aggtaagaattatgacc

SEQ ID NO: 114 - DNA, 18 bp, synthetic construct
  misc_feature 1..18: note = Oligonucleotide motif
  source 1..18: mol_type = other DNA
tcaggtaagaattatgac

SEQ ID NO: 115 - DNA, 18 bp, synthetic construct
  misc_feature 1..18: note = Oligonucleotide motif
  source 1..18: mol_type = other DNA
cttcaggtaagaattatg

SEQ ID NO: 116 - DNA, 17 bp, synthetic construct
  misc_feature 1..17: note = Oligonucleotide motif
  source 1..17: mol_type = other DNA
tcttcaggtaagaatta

SEQ ID NO: 117 - DNA, 17 bp, synthetic construct
  misc_feature 1..17: note = Oligonucleotide motif
  source 1..17: mol_type = other DNA
cttcttcaggtaagaat

SEQ ID NO: 118 - DNA, 17 bp, synthetic construct
  misc_feature 1..17: note = Oligonucleotide motif
  source 1..17: mol_type = other DNA
tcttcttcaggtaagaa

SEQ ID NO: 119 - DNA, 16 bp, synthetic construct
  misc_feature 1..16: note = Oligonucleotide motif
  source 1..16: mol_type = other DNA
tcttcttcaggtaaga

SEQ ID NO: 120 - DNA, 17 bp, synthetic construct
  misc_feature 1..17: note = Oligonucleotide motif
  source 1..17: mol_type = other DNA
tggtctaagagaagaag

SEQ ID NO: 121 - DNA, 16 bp, synthetic construct
  misc_feature 1..16: note = Oligonucleotide motif
  source 1..16: mol_type = other DNA
gttggtctaagagaag

SEQ ID NO: 122 - DNA, 16 bp, synthetic construct
  misc_feature 1..16: note = Oligonucleotide motif
  source 1..16: mol_type = other DNA
agttggtctaagagaa

SEQ ID NO: 123 - DNA, 17 bp, synthetic construct
  misc_feature 1..17: note = Oligonucleotide motif
  source 1..17: mol_type = other DNA
cagttggtctaagagaa

SEQ ID NO: 124 - DNA, 18 bp, synthetic construct
  misc_feature 1..18: note = Oligonucleotide motif
  source 1..18: mol_type = other DNA
gcagttggtctaagagaa

SEQ ID NO: 125 - DNA, 16 bp, synthetic construct
  misc_feature 1..16: note = Oligonucleotide motif
  source 1..16: mol_type = other DNA
cagttggtctaagaga

SEQ ID NO: 126 - DNA, 17 bp, synthetic construct
  misc_feature 1..17: note = Oligonucleotide motif
  source 1..17: mol_type = other DNA
gcagttggtctaagaga

SEQ ID NO: 127 - DNA, 16 bp, synthetic construct
  misc_feature 1..16: note = Oligonucleotide motif
  source 1..16: mol_type = other DNA
gcagttggtctaagag

SEQ ID NO: 128 - DNA, 16 bp, synthetic construct
  misc_feature 1..16: note = Oligonucleotide motif
  source 1..16: mol_type = other DNA
ctcatatcagggcagt

SEQ ID NO: 129 - DNA, 17 bp, synthetic construct
  misc_feature 1..17: note = Oligonucleotide motif
  source 1..17: mol_type = other DNA
cacacatgttctttaac

SEQ ID NO: 130 - DNA, 18 bp, synthetic construct
  misc_feature 1..18: note = Oligonucleotide motif
  source 1..18: mol_type = other DNA
taaatacacacatgttct

SEQ ID NO: 131 - DNA, 18 bp, synthetic construct
  misc_feature 1..18: note = Oligonucleotide motif
  source 1..18: mol_type = other DNA
gtaaatacacacatgttc

SEQ ID NO: 132 - DNA, 18 bp, synthetic construct
  misc_feature 1..18: note = Oligonucleotide motif
  source 1..18: mol_type = other DNA
tgtaaatacacacatgtt

SEQ ID NO: 133 - DNA, 18 bp, synthetic construct
  misc_feature 1..18: note = Oligonucleotide motif
  source 1..18: mol_type = other DNA
gatcatgtaaatacacac

SEQ ID NO: 134 - DNA, 18 bp, synthetic construct
  misc_feature 1..18: note = Oligonucleotide motif
  source 1..18: mol_type = other DNA
agatcatgtaaatacaca

SEQ ID NO: 135 - DNA, 20 bp, synthetic construct
  misc_feature 1..20: note = Oligonucleotide motif
  source 1..20: mol_type = other DNA
caaagatcatgtaaatacac

SEQ ID NO: 136 - DNA, 20 bp, synthetic construct
  misc_feature 1..20: note = Oligonucleotide motif
  source 1..20: mol_type = other DNA
acaaagatcatgtaaataca

SEQ ID NO: 137 - DNA, 18 bp, synthetic construct
  misc_feature 1..18: note = Oligonucleotide motif
  source 1..18: mol_type = other DNA
gaatacaaagatcatgta

SEQ ID NO: 138 - DNA, 18 bp, synthetic construct
  misc_feature 1..18: note = Oligonucleotide motif
  source 1..18: mol_type = other DNA
agaatacaaagatcatgt

SEQ ID NO: 139 - DNA, 18 bp, synthetic construct
  misc_feature 1..18: note = Oligonucleotide motif
  source 1..18: mol_type = other DNA
cagaatacaaagatcatg

SEQ ID NO: 140 - DNA, 17 bp, synthetic construct
  misc_feature 1..17: note = Oligonucleotide motif
  source 1..17: mol_type = other DNA
gcagaatacaaagatca

SEQ ID NO: 141 - DNA, 17 bp, synthetic construct
  misc_feature 1..17: note = Oligonucleotide motif
  source 1..17: mol_type = other DNA
aggcagaatacaaagat

SEQ ID NO: 142 - DNA, 17 bp, synthetic construct
  misc_feature 1..17: note = Oligonucleotide motif
  source 1..17: mol_type = other DNA
aaggcagaatacaaaga

SEQ ID NO: 143 - DNA, 16 bp, synthetic construct
  misc_feature 1..16: note = Oligonucleotide motif
  source 1..16: mol_type = other DNA
attagtgagggacgaa

SEQ ID NO: 144 - DNA, 16 bp, synthetic construct
  misc_feature 1..16: note = Oligonucleotide motif
  source 1..16: mol_type = other DNA
cattagtgagggacga

SEQ ID NO: 145 - DNA, 16 bp, synthetic construct
  misc_feature 1..16: note = Oligonucleotide motif
  source 1..16: mol_type = other DNA
gagggtgatggattag

SEQ ID NO: 146 - DNA, 16 bp, synthetic construct
  misc_feature 1..16: note = Oligonucleotide motif
  source 1..16: mol_type = other DNA
ttaggagtaataaagg

SEQ ID NO: 147 - DNA, 16 bp, synthetic construct
  misc_feature 1..16: note = Oligonucleotide motif
  source 1..16: mol_type = other DNA
ttaatgaatttggttg

SEQ ID NO: 148 - DNA, 16 bp, synthetic construct
  misc_feature 1..16: note = Oligonucleotide motif
  source 1..16: mol_type = other DNA
ctttaatgaatttggt

SEQ ID NO: 149 - DNA, 16 bp, synthetic construct
  misc_feature 1..16: note = Oligonucleotide motif
  source 1..16: mol_type = other DNA
catggattacaactaa

SEQ ID NO: 150 - DNA, 16 bp, synthetic construct
  misc_feature 1..16: note = Oligonucleotide motif
  source 1..16: mol_type = other DNA
tcatggattacaacta

SEQ ID NO: 151 - DNA, 16 bp, synthetic construct
  misc_feature 1..16: note = Oligonucleotide motif
  source 1..16: mol_type = other DNA
gtcatggattacaact

SEQ ID NO: 152 - DNA, 16 bp, synthetic construct
  misc_feature 1..16: note = Oligonucleotide motif
  source 1..16: mol_type = other DNA
cattaaatctagtcat

SEQ ID NO: 153 - DNA, 17 bp, synthetic construct
  misc_feature 1..17: note = Oligonucleotide motif
  source 1..17: mol_type = other DNA
gacattaaatctagtca

SEQ ID NO: 154 - DNA, 16 bp, synthetic construct
  misc_feature 1..16: note = Oligonucleotide motif
  source 1..16: mol_type = other DNA
agggacattaaatcta

SEQ ID NO: 155 - DNA, 16 bp, synthetic construct
  misc_feature 1..16: note = Oligonucleotide motif
  source 1..16: mol_type = other DNA
caaagcattataacca

SEQ ID NO: 156 - DNA, 16 bp, synthetic construct
  misc_feature 1..16: note = Oligonucleotide motif
  source 1..16: mol_type = other DNA
acttactaggcagaag

SEQ ID NO: 157 - DNA, 16 bp, synthetic construct
  misc_feature 1..16: note = Oligonucleotide motif
  source 1..16: mol_type = other DNA
cagagttaactgtaca

SEQ ID NO: 158 - DNA, 16 bp, synthetic construct
  misc_feature 1..16: note = Oligonucleotide motif
  source 1..16: mol_type = other DNA
ccagagttaactgtac

SEQ ID NO: 159 - DNA, 16 bp, synthetic construct
  misc_feature 1..16: note = Oligonucleotide motif
  source 1..16: mol_type = other DNA
gccagagttaactgta

SEQ ID NO: 160 - DNA, 16 bp, synthetic construct
  misc_feature 1..16: note = Oligonucleotide motif
  source 1..16: mol_type = other DNA
tgggccagagttaact

SEQ ID NO: 161 - DNA, 16 bp, synthetic construct
  misc_feature 1..16: note = Oligonucleotide motif
  source 1..16: mol_type = other DNA
cagcatctatcagact

SEQ ID NO: 162 - DNA, 18 bp, synthetic construct
  misc_feature 1..18: note = Oligonucleotide motif
  source 1..18: mol_type = other DNA
tgaaataacatgagtcat

SEQ ID NO: 163 - DNA, 17 bp, synthetic construct
  misc_feature 1..17: note = Oligonucleotide motif
  source 1..17: mol_type = other DNA
gtgaaataacatgagtc

SEQ ID NO: 164 - DNA, 16 bp, synthetic construct
  misc_feature 1..16: note = Oligonucleotide motif
  source 1..16: mol_type = other DNA
tctgtttatgtcactg

SEQ ID NO: 165 - DNA, 16 bp, synthetic construct
  misc_feature 1..16: note = Oligonucleotide motif
  source 1..16: mol_type = other DNA
gtctgtttatgtcact

SEQ ID NO: 166 - DNA, 16 bp, synthetic construct
  misc_feature 1..16: note = Oligonucleotide motif
  source 1..16: mol_type = other DNA
tggtctgtttatgtca

SEQ ID NO: 167 - DNA, 16 bp, synthetic construct
  misc_feature 1..16: note = Oligonucleotide motif
  source 1..16: mol_type = other DNA
ttggtctgtttatgtc

SEQ ID NO: 168 - DNA, 16 bp, synthetic construct
  misc_feature 1..16: note = Oligonucleotide motif
  source 1..16: mol_type = other DNA
tcacccattgtttaaa

SEQ ID NO: 169 - DNA, 16 bp, synthetic construct
  misc_feature 1..16: note = Oligonucleotide motif
  source 1..16: mol_type = other DNA
ttcagcaaatattcgt

SEQ ID NO: 170 - DNA, 17 bp, synthetic construct
  misc_feature 1..17: note = Oligonucleotide motif
  source 1..17: mol_type = other DNA
gtgtgttcagcaaatat

SEQ ID NO: 171 - DNA, 16 bp, synthetic construct
  misc_feature 1..16: note = Oligonucleotide motif
  source 1..16: mol_type = other DNA
tctattgttaggtatc

SEQ ID NO: 172 - DNA, 16 bp, synthetic construct
  misc_feature 1..16: note = Oligonucleotide motif
  source 1..16: mol_type = other DNA
attgcccatcttactg

SEQ ID NO: 173 - DNA, 16 bp, synthetic construct
  misc_feature 1..16: note = Oligonucleotide motif
  source 1..16: mol_type = other DNA
tattgcccatcttact

SEQ ID NO: 174 - DNA, 16 bp, synthetic construct
  misc_feature 1..16: note = Oligonucleotide motif
  source 1..16: mol_type = other DNA
aaatattgcccatctt

SEQ ID NO: 175 - DNA, 16 bp, synthetic construct
  misc_feature 1..16: note = Oligonucleotide motif
  source 1..16: mol_type = other DNA
ataaccttatcataca

SEQ ID NO: 176 - DNA, 16 bp, synthetic construct
  misc_feature 1..16: note = Oligonucleotide motif
  source 1..16: mol_type = other DNA
tataaccttatcatac

SEQ ID NO: 177 - DNA, 16 bp, synthetic construct
  misc_feature 1..16: note = Oligonucleotide motif
  source 1..16: mol_type = other DNA
ttataaccttatcata

SEQ ID NO: 178 - DNA, 16 bp, synthetic construct
  misc_feature 1..16: note = Oligonucleotide motif
  source 1..16: mol_type = other DNA
tttataaccttatcat

SEQ ID NO: 179 - DNA, 16 bp, synthetic construct
  misc_feature 1..16: note = Oligonucleotide motif
  source 1..16: mol_type = other DNA
actgctattgctatct

SEQ ID NO: 180 - DNA, 16 bp, synthetic construct
  misc_feature 1..16: note = Oligonucleotide motif
  source 1..16: mol_type = other DNA
aggactgctattgcta

SEQ ID NO: 181 - DNA, 16 bp, synthetic construct
  misc_feature 1..16: note = Oligonucleotide motif
  source 1..16: mol_type = other DNA
gaggactgctattgct

SEQ ID NO: 182 - DNA, 16 bp, synthetic construct
  misc_feature 1..16: note = Oligonucleotide motif
  source 1..16: mol_type = other DNA
acgtagaataataaca

SEQ ID NO: 183 - DNA, 16 bp, synthetic construct
  misc_feature 1..16: note = Oligonucleotide motif
  source 1..16: mol_type = other DNA
ccaagtgatataatgg

SEQ ID NO: 184 - DNA, 16 bp, synthetic construct
  misc_feature 1..16: note = Oligonucleotide motif
  source 1..16: mol_type = other DNA
ttagcagaccaagtga

SEQ ID NO: 185 - DNA, 16 bp, synthetic construct
  misc_feature 1..16: note = Oligonucleotide motif
  source 1..16: mol_type = other DNA
gtttagcagaccaagt

SEQ ID NO: 186 - DNA, 16 bp, synthetic construct
  misc_feature 1..16: note = Oligonucleotide motif
  source 1..16: mol_type = other DNA
tgacagtgattatatt

SEQ ID NO: 187 - DNA, 16 bp, synthetic construct
  misc_feature 1..16: note = Oligonucleotide motif
  source 1..16: mol_type = other DNA
tgtccaagatattgac

SEQ ID NO: 188 - DNA, 16 bp, synthetic construct
  misc_feature 1..16: note = Oligonucleotide motif
  source 1..16: mol_type = other DNA
gaatatcctagattgt

SEQ ID NO: 189 - DNA, 16 bp, synthetic construct
  misc_feature 1..16: note = Oligonucleotide motif
  source 1..16: mol_type = other DNA
caaactgagaatatcc

SEQ ID NO: 190 - DNA, 16 bp, synthetic construct
  misc_feature 1..16: note = Oligonucleotide motif
  source 1..16: mol_type = other DNA
gcaaactgagaatatc

SEQ ID NO: 191 - DNA, 16 bp, synthetic construct
  misc_feature 1..16: note = Oligonucleotide motif
  source 1..16: mol_type = other DNA
tcctattacaatcgta

SEQ ID NO: 192 - DNA, 16 bp, synthetic construct
  misc_feature 1..16: note = Oligonucleotide motif
  source 1..16: mol_type = other DNA
ttcctattacaatcgt

SEQ ID NO: 193 - DNA, 16 bp, synthetic construct
  misc_feature 1..16: note = Oligonucleotide motif
  source 1..16: mol_type = other DNA
actaatgggaggattt

SEQ ID NO: 194 - DNA, 16 bp, synthetic construct
  misc_feature 1..16: note = Oligonucleotide motif
  source 1..16: mol_type = other DNA
tagttcagagaataag

SEQ ID NO: 195 - DNA, 16 bp, synthetic construct
  misc_feature 1..16: note = Oligonucleotide motif
  source 1..16: mol_type = other DNA
taacatatagttcaga

SEQ ID NO: 196 - DNA, 16 bp, synthetic construct
  misc_feature 1..16: note = Oligonucleotide motif
  source 1..16: mol_type = other DNA
ataacatatagttcag

SEQ ID NO: 197 - DNA, 16 bp, synthetic construct
  misc_feature 1..16: note = Oligonucleotide motif
  source 1..16: mol_type = other DNA
cataacatatagttca

SEQ ID NO: 198 - DNA, 16 bp, synthetic construct
  misc_feature 1..16: note = Oligonucleotide motif
  source 1..16: mol_type = other DNA
tcataacatatagttc

SEQ ID NO: 199 - DNA, 16 bp, synthetic construct
  misc_feature 1..16: note = Oligonucleotide motif
  source 1..16: mol_type = other DNA
tagctcctaacaatca

SEQ ID NO: 200 - DNA, 16 bp, synthetic construct
  misc_feature 1..16: note = Oligonucleotide motif
  source 1..16: mol_type = other DNA
ctccaatctttgtata

SEQ ID NO: 201 - DNA, 16 bp, synthetic construct
  misc_feature 1..16: note = Oligonucleotide motif
  source 1..16: mol_type = other DNA
tctccaatctttgtat

SEQ ID NO: 202 - DNA, 16 bp, synthetic construct
  misc_feature 1..16: note = Oligonucleotide motif
  source 1..16: mol_type = other DNA
tctatttcagccaatc

SEQ ID NO: 203 - DNA, 16 bp, synthetic construct
  misc_feature 1..16: note = Oligonucleotide motif
  source 1..16: mol_type = other DNA
cggaagtcagagtgaa

SEQ ID NO: 204 - DNA, 16 bp, synthetic construct
  misc_feature 1..16: note = Oligonucleotide motif
  source 1..16: mol_type = other DNA
ttaagcatgaggaata

SEQ ID NO: 205 - DNA, 16 bp, synthetic construct
  misc_feature 1..16: note = Oligonucleotide motif
  source 1..16: mol_type = other DNA
tgattgagcacctctt

SEQ ID NO: 206 - DNA, 16 bp, synthetic construct
  misc_feature 1..16: note = Oligonucleotide motif
  source 1..16: mol_type = other DNA
gactaattatttcgtt

SEQ ID NO: 207 - DNA, 16 bp, synthetic construct
  misc_feature 1..16: note = Oligonucleotide motif
  source 1..16: mol_type = other DNA
tgactaattatttcgt

SEQ ID NO: 208 - DNA, 16 bp, synthetic construct
  misc_feature 1..16: note = Oligonucleotide motif
  source 1..16: mol_type = other DNA
gtgactaattatttcg

SEQ ID NO: 209 - DNA, 16 bp, synthetic construct
  misc_feature 1..16: note = Oligonucleotide motif
  source 1..16: mol_type = other DNA
ctgcttgaaatgtgac

SEQ ID NO: 210 - DNA, 16 bp, synthetic construct
  misc_feature 1..16: note = Oligonucleotide motif
  source 1..16: mol_type = other DNA
cctgcttgaaatgtga

SEQ ID NO: 211 - DNA, 16 bp, synthetic construct
  misc_feature 1..16: note = Oligonucleotide motif
  source 1..16: mol_type = other DNA
atcctgcttgaaatgt

SEQ ID NO: 212 - DNA, 16 bp, synthetic construct
  misc_feature 1..16: note = Oligonucleotide motif
  source 1..16: mol_type = other DNA
attataaatctattct

SEQ ID NO: 213 - DNA, 16 bp, synthetic construct
  misc_feature 1..16: note = Oligonucleotide motif
  source 1..16: mol_type = other DNA
gctaaatactttcatc

SEQ ID NO: 214 - DNA, 16 bp, synthetic construct
  misc_feature 1..16: note = Oligonucleotide motif
  source 1..16: mol_type = other DNA
cattgtaacataccta

SEQ ID NO: 215 - DNA, 16 bp, synthetic construct
  misc_feature 1..16: note = Oligonucleotide motif
  source 1..16: mol_type = other DNA
gcattgtaacatacct

SEQ ID NO: 216 - DNA, 16 bp, synthetic construct
  misc_feature 1..16: note = Oligonucleotide motif
  source 1..16: mol_type = other DNA
taatattgcaccaaat

SEQ ID NO: 217 - DNA, 16 bp, synthetic construct
  misc_feature 1..16: note = Oligonucleotide motif
  source 1..16: mol_type = other DNA
gataatattgcaccaa

SEQ ID NO: 218 - DNA, 16 bp, synthetic construct
  misc_feature 1..16: note = Oligonucleotide motif
  source 1..16: mol_type = other DNA
agataatattgcacca

SEQ ID NO: 219 - DNA, 16 bp, synthetic construct
  misc_feature 1..16: note = Oligonucleotide motif
  source 1..16: mol_type = other DNA
gccaagaagataatat

SEQ ID NO: 220 - DNA, 16 bp, synthetic construct
  misc_feature 1..16: note = Oligonucleotide motif
  source 1..16: mol_type = other DNA
cacagccacataaact

SEQ ID NO: 221 - DNA, 16 bp, synthetic construct
  misc_feature 1..16: note = Oligonucleotide motif
  source 1..16: mol_type = other DNA
ttgtaattgtggaaac

SEQ ID NO: 222 - DNA, 16 bp, synthetic construct
  misc_feature 1..16: note = Oligonucleotide motif
  source 1..16: mol_type = other DNA
tgacttgtaattgtgg

SEQ ID NO: 223 - DNA, 16 bp, synthetic construct
  misc_feature 1..16: note = Oligonucleotide motif
  source 1..16: mol_type = other DNA
tctaactgaaatagtc

SEQ ID NO: 224 - DNA, 16 bp, synthetic construct
  misc_feature 1..16: note = Oligonucleotide motif
  source 1..16: mol_type = other DNA
gtggttctaactgaaa

SEQ ID NO: 225 - DNA, 16 bp, synthetic construct
  misc_feature 1..16: note = Oligonucleotide motif
  source 1..16: mol_type = other DNA
caatatgggacttggt

SEQ ID NO: 226 - DNA, 16 bp, synthetic construct
  misc_feature 1..16: note = Oligonucleotide motif
  source 1..16: mol_type = other DNA
atgacaatatgggact

SEQ ID NO: 227 - DNA, 16 bp, synthetic construct
  misc_feature 1..16: note = Oligonucleotide motif
  source 1..16: mol_type = other DNA
tatgacaatatgggac

SEQ ID NO: 228 - DNA, 16 bp, synthetic construct
  misc_feature 1..16: note = Oligonucleotide motif
  source 1..16: mol_type = other DNA
atatgacaatatggga

SEQ ID NO: 229 - DNA, 16 bp, synthetic construct
  misc_feature 1..16: note = Oligonucleotide motif
  source 1..16: mol_type = other DNA
cttcacttaataatta

SEQ ID NO: 230 - DNA, 16 bp, synthetic construct
  misc_feature 1..16: note = Oligonucleotide motif
  source 1..16: mol_type = other DNA
ctgcttcacttaataa

SEQ ID NO: 231 - DNA, 16 bp, synthetic construct
  misc_feature 1..16: note = Oligonucleotide motif
  source 1..16: mol_type = other DNA
aagactgcttcactta

SEQ ID NO: 232 - DNA, 16 bp, synthetic construct
  misc_feature 1..16: note = Oligonucleotide motif
  source 1..16: mol_type = other DNA
gaatgccctaattatg

SEQ ID NO: 233 - DNA, 16 bp, synthetic construct
  misc_feature 1..16: note = Oligonucleotide motif
  source 1..16: mol_type = other DNA
tggaatgccctaatta

SEQ ID NO: 234 - DNA, 16 bp, synthetic construct
  misc_feature 1..16: note = Oligonucleotide motif
  source 1..16: mol_type = other DNA
gcaaatgccagtaggt

SEQ ID NO: 235 - DNA, 16 bp, synthetic construct
  misc_feature 1..16: note = Oligonucleotide motif
  source 1..16: mol_type = other DNA
ctaatggaaggatttg

SEQ ID NO: 236 - DNA, 16 bp, synthetic construct
  misc_feature 1..16: note = Oligonucleotide motif
  source 1..16: mol_type = other DNA
aatatagaacctaatg

SEQ ID NO: 237 - DNA, 16 bp, synthetic construct
  misc_feature 1..16: note = Oligonucleotide motif
  source 1..16: mol_type = other DNA
gaaagaatagaatgtt

SEQ ID NO: 238 - DNA, 16 bp, synthetic construct
  misc_feature 1..16: note = Oligonucleotide motif
  source 1..16: mol_type = other DNA
atgggtaatagattat

SEQ ID NO: 239 - DNA, 16 bp, synthetic construct
  misc_feature 1..16: note = Oligonucleotide motif
  source 1..16: mol_type = other DNA
gaaagagcacagggtg

SEQ ID NO: 240 - DNA, 16 bp, synthetic construct
  misc_feature 1..16: note = Oligonucleotide motif
  source 1..16: mol_type = other DNA
ctacatagagggaatg

SEQ ID NO: 241 - DNA, 16 bp, synthetic construct
  misc_feature 1..16: note = Oligonucleotide motif
  source 1..16: mol_type = other DNA
gcttcctacatagagg

SEQ ID NO: 242 - DNA, 16 bp, synthetic construct
  misc_feature 1..16: note = Oligonucleotide motif
  source 1..16: mol_type = other DNA
tgcttcctacatagag

SEQ ID NO: 243 - DNA, 16 bp, synthetic construct
  misc_feature 1..16: note = Oligonucleotide motif
  source 1..16: mol_type = other DNA
tgggcttgaaatatgt

SEQ ID NO: 244 - DNA, 16 bp, synthetic construct
  misc_feature 1..16: note = Oligonucleotide motif
  source 1..16: mol_type = other DNA
cattatatttaagaac

SEQ ID NO: 245 - DNA, 16 bp, synthetic construct
  misc_feature 1..16: note = Oligonucleotide motif
  source 1..16: mol_type = other DNA
tcggttatgttatcat

SEQ ID NO: 246 - DNA, 16 bp, synthetic construct
  misc_feature 1..16: note = Oligonucleotide motif
  source 1..16: mol_type = other DNA
cactttatctggtcgg

SEQ ID NO: 247 - DNA, 16 bp, synthetic construct
  misc_feature 1..16: note = Oligonucleotide motif
  source 1..16: mol_type = other DNA
aaattggcacagcgtt

SEQ ID NO: 248 - DNA, 16 bp, synthetic construct
  misc_feature 1..16: note = Oligonucleotide motif
  source 1..16: mol_type = other DNA
accgtgacagtaaatg

SEQ ID NO: 249 - DNA, 17 bp, synthetic construct
  misc_feature 1..17: note = Oligonucleotide motif
  source 1..17: mol_type = other DNA
tgggaaccgtgacagta

SEQ ID NO: 250 - DNA, 16 bp, synthetic construct
  misc_feature 1..16: note = Oligonucleotide motif
  source 1..16: mol_type = other DNA
ccacatataggtcctt

SEQ ID NO: 251 - DNA, 16 bp, synthetic construct
  misc_feature 1..16: note = Oligonucleotide motif
  source 1..16: mol_type = other DNA
catattgctaccatac

SEQ ID NO: 252 - DNA, 16 bp, synthetic construct
  misc_feature 1..16: note = Oligonucleotide motif
  source 1..16: mol_type = other DNA
tcatattgctaccata

SEQ ID NO: 253 - DNA, 16 bp, synthetic construct
  misc_feature 1..16: note = Oligonucleotide motif
  source 1..16: mol_type = other DNA
caattgtcatattgct

SEQ ID NO: 254 - DNA, 18 bp, synthetic construct
  misc_feature 1..18: note = Oligonucleotide motif
  source 1..18: mol_type = other DNA
cattcaattgtcatattg

SEQ ID NO: 255 - DNA, 17 bp, synthetic construct
  misc_feature 1..17: note = Oligonucleotide motif
  source 1..17: mol_type = other DNA
tttctactgggaatttg

SEQ ID NO: 256 - DNA, 16 bp, synthetic construct
  misc_feature 1..16: note = Oligonucleotide motif
  source 1..16: mol_type = other DNA
caattagtgcagccag

SEQ ID NO: 257 - DNA, 17 bp, synthetic construct
  misc_feature 1..17: note = Oligonucleotide motif
  source 1..17: mol_type = other DNA
gaataatgttcttatcc

SEQ ID NO: 258 - DNA, 20 bp, synthetic construct
  misc_feature 1..20: note = Oligonucleotide motif
  source 1..20: mol_type = other DNA
cacaaattgaataatgttct

SEQ ID NO: 259 - DNA, 19 bp, synthetic construct
  misc_feature 1..19: note = Oligonucleotide motif
  source 1..19: mol_type = other DNA
catgcacaaattgaataat

SEQ ID NO: 260 - DNA, 17 bp, synthetic construct
  misc_feature 1..17: note = Oligonucleotide motif
  source 1..17: mol_type = other DNA
atcctgcaatttcacat

SEQ ID NO: 261 - DNA, 16 bp, synthetic construct
  misc_feature 1..16: note = Oligonucleotide motif
  source 1..16: mol_type = other DNA
ccaccatagctgatca

SEQ ID NO: 262 - DNA, 17 bp, synthetic construct
  misc_feature 1..17: note = Oligonucleotide motif
  source 1..17: mol_type = other DNA
accaccatagctgatca

SEQ ID NO: 263 - DNA, 17 bp, synthetic construct
  misc_feature 1..17: note = Oligonucleotide motif
  source 1..17: mol_type = other DNA
caccaccatagctgatc

SEQ ID NO: 264 - DNA, 16 bp, synthetic construct
  misc_feature 1..16: note = Oligonucleotide motif
  source 1..16: mol_type = other DNA
tagtcggcaccaccat

SEQ ID NO: 265 - DNA, 17 bp, synthetic construct
  misc_feature 1..17: note = Oligonucleotide motif
  source 1..17: mol_type = other DNA
cttgtagtcggcaccac

SEQ ID NO: 266 - DNA, 16 bp, synthetic construct
  misc_feature 1..16: note = Oligonucleotide motif
  source 1..16: mol_type = other DNA
cttgtagtcggcacca

SEQ ID NO: 267 - DNA, 16 bp, synthetic construct
  misc_feature 1..16: note = Oligonucleotide motif
  source 1..16: mol_type = other DNA
cgcttgtagtcggcac

SEQ ID NO: 268 - DNA, 16 bp, synthetic construct
  misc_feature 1..16: note = Oligonucleotide motif
  source 1..16: mol_type = other DNA
tcaataaagatcaggc

SEQ ID NO: 269 - DNA, 16 bp, synthetic construct
  misc_feature 1..16: note = Oligonucleotide motif
  source 1..16: mol_type = other DNA
tggacttacaagaatg

SEQ ID NO: 270 - DNA, 16 bp, synthetic construct
  misc_feature 1..16: note = Oligonucleotide motif
  source 1..16: mol_type = other DNA
atggacttacaagaat

SEQ ID NO: 271 - DNA, 16 bp, synthetic construct
  misc_feature 1..16: note = Oligonucleotide motif
  source 1..16: mol_type = other DNA
gctcaagaaattggat

SEQ ID NO: 272 - DNA, 16 bp, synthetic construct
  misc_feature 1..16: note = Oligonucleotide motif
  source 1..16: mol_type = other DNA
tactgtagaacatggc

SEQ ID NO: 273 - DNA, 16 bp, synthetic construct
  misc_feature 1..16: note = Oligonucleotide motif
  source 1..16: mol_type = other DNA
gcaattcatttgatct

SEQ ID NO: 274 - DNA, 18 bp, synthetic construct
  misc_feature 1..18: note = Oligonucleotide motif
  source 1..18: mol_type = other DNA
tgaagggaggagggacac

SEQ ID NO: 275 - DNA, 17 bp, synthetic construct
  misc_feature 1..17: note = Oligonucleotide motif
  source 1..17: mol_type = other DNA
agtggtgaagggaggag

SEQ ID NO: 276 - DNA, 18 bp, synthetic construct
  misc_feature 1..18: note = Oligonucleotide motif
  source 1..18: mol_type = other DNA
tagtggtgaagggaggag

SEQ ID NO: 277 - DNA, 19 bp, synthetic construct
  misc_feature 1..19: note = Oligonucleotide motif
  source 1..19: mol_type = other DNA
atagtggtgaagggaggag

SEQ ID NO: 278 - DNA, 17 bp, synthetic construct
  misc_feature 1..17: note = Oligonucleotide motif
  source 1..17: mol_type = other DNA
tagtggtgaagggagga

SEQ ID NO: 279 - DNA, 18 bp, synthetic construct
  misc_feature 1..18: note = Oligonucleotide motif
  source 1..18: mol_type = other DNA
atagtggtgaagggagga

SEQ ID NO: 280 - DNA, 16 bp, synthetic construct
  misc_feature 1..16: note = Oligonucleotide motif
  source 1..16: mol_type = other DNA
tagtggtgaagggagg

SEQ ID NO: 281 - DNA, 17 bp, synthetic construct
  misc_feature 1..17: note = Oligonucleotide motif
  source 1..17: mol_type = other DNA
atagtggtgaagggagg

SEQ ID NO: 282 - DNA, 18 bp, synthetic construct
  misc_feature 1..18: note = Oligonucleotide motif
  source 1..18: mol_type = other DNA
gatagtggtgaagggagg

SEQ ID NO: 283 - DNA, 16 bp, synthetic construct
  misc_feature 1..16: note = Oligonucleotide motif
  source 1..16: mol_type = other DNA
atagtggtgaagggag

SEQ ID NO: 284 - DNA, 17 bp, synthetic construct
  misc_feature 1..17: note = Oligonucleotide motif
  source 1..17: mol_type = other DNA
gatagtggtgaagggag

SEQ ID NO: 285 - DNA, 16 bp, synthetic construct
  misc_feature 1..16: note = Oligonucleotide motif
  source 1..16: mol_type = other DNA
gagatagtggtgaagg

SEQ ID NO: 286 - DNA, 16 bp, synthetic construct
  misc_feature 1..16: note = Oligonucleotide motif
  source 1..16: mol_type = other DNA
catgggagatagtggt

SEQ ID NO: 287 - DNA, 18 bp, synthetic construct
  misc_feature 1..18: note = Oligonucleotide motif
  source 1..18: mol_type = other DNA
acaaataatggttactct

SEQ ID NO: 288 - DNA, 18 bp, synthetic construct
  misc_feature 1..18: note = Oligonucleotide motif
  source 1..18: mol_type = other DNA
acacacaaataatggtta

SEQ ID NO: 289 - DNA, 18 bp, synthetic construct
  misc_feature 1..18: note = Oligonucleotide motif
  source 1..18: mol_type = other DNA
gagggacacacaaataat

SEQ ID NO: 290 - DNA, 16 bp, synthetic construct
  misc_feature 1..16: note = Oligonucleotide motif
  source 1..16: mol_type = other DNA
atatagagaggctcaa

SEQ ID NO: 291 - DNA, 16 bp, synthetic construct
  misc_feature 1..16: note = Oligonucleotide motif
  source 1..16: mol_type = other DNA
ttgatatagagaggct

SEQ ID NO: 292 - DNA, 16 bp, synthetic construct
  misc_feature 1..16: note = Oligonucleotide motif
  source 1..16: mol_type = other DNA
gcatttgatatagaga

SEQ ID NO: 293 - DNA, 16 bp, synthetic construct
  misc_feature 1..16: note = Oligonucleotide motif
  source 1..16: mol_type = other DNA
tttgcatttgatatag

SEQ ID NO: 294 - DNA, 16 bp, synthetic construct
  misc_feature 1..16: note = Oligonucleotide motif
  source 1..16: mol_type = other DNA
ctggaagaataggttc

SEQ ID NO: 295 - DNA, 16 bp, synthetic construct
  misc_feature 1..16: note = Oligonucleotide motif
  source 1..16: mol_type = other DNA
actggaagaataggtt

SEQ ID NO: 296 - DNA, 16 bp, synthetic construct
  misc_feature 1..16: note = Oligonucleotide motif
  source 1..16: mol_type = other DNA
tactggaagaataggt

SEQ ID NO: 297 - DNA, 16 bp, synthetic construct
  misc_feature 1..16: note = Oligonucleotide motif
  source 1..16: mol_type = other DNA
tggcttatcctgtact

SEQ ID NO: 298 - DNA, 16 bp, synthetic construct
  misc_feature 1..16: note = Oligonucleotide motif
  source 1..16: mol_type = other DNA
atggcttatcctgtac

SEQ ID NO: 299 - DNA, 16 bp, synthetic construct
  misc_feature 1..16: note = Oligonucleotide motif
  source 1..16: mol_type = other DNA
tatggcttatcctgta

SEQ ID NO: 300 - DNA, 16 bp, synthetic construct
  misc_feature 1..16: note = Oligonucleotide motif
  source 1..16: mol_type = other DNA
gtatggcttatcctgt

SEQ ID NO: 301 - DNA, 17 bp, synthetic construct
  misc_feature 1..17: note = Oligonucleotide motif
  source 1..17: mol_type = other DNA
atgaatatatgcccagt

SEQ ID NO: 302 - DNA, 16 bp, synthetic construct
  misc_feature 1..16: note = Oligonucleotide motif
  source 1..16: mol_type = other DNA
gatgaatatatgccca

SEQ ID NO: 303 - DNA, 17 bp, synthetic construct
  misc_feature 1..17: note = Oligonucleotide motif
  source 1..17: mol_type = other DNA
caagatgaatatatgcc

SEQ ID NO: 304 - DNA, 17 bp, synthetic construct
  misc_feature 1..17: note = Oligonucleotide motif
  source 1..17: mol_type = other DNA
gacaacatcagtataga

SEQ ID NO: 305 - DNA, 16 bp, synthetic construct
  misc_feature 1..16: note = Oligonucleotide motif
  source 1..16: mol_type = other DNA
caagacaacatcagta

SEQ ID NO: 306 - DNA, 16 bp, synthetic construct
  misc_feature 1..16: note = Oligonucleotide motif
  source 1..16: mol_type = other DNA
cactcctagttccttt

SEQ ID NO: 307 - DNA, 16 bp, synthetic construct
  misc_feature 1..16: note = Oligonucleotide motif
  source 1..16: mol_type = other DNA
aacactcctagttcct

SEQ ID NO: 308 - DNA, 16 bp, synthetic construct
  misc_feature 1..16: note = Oligonucleotide motif
  source 1..16: mol_type = other DNA
taacactcctagttcc

SEQ ID NO: 309 - DNA, 16 bp, synthetic construct
  misc_feature 1..16: note = Oligonucleotide motif
  source 1..16: mol_type = other DNA
ctaacactcctagttc

SEQ ID NO: 310 - DNA, 16 bp, synthetic construct
  misc_feature 1..16: note = Oligonucleotide motif
  source 1..16: mol_type = other DNA
tgataacataactgtg

SEQ ID NO: 311 - DNA, 16 bp, synthetic construct
  misc_feature 1..16: note = Oligonucleotide motif
  source 1..16: mol_type = other DNA
ctgataacataactgt

SEQ ID NO: 312 - DNA, 16 bp, synthetic construct
  misc_feature 1..16: note = Oligonucleotide motif
  source 1..16: mol_type = other DNA
tttgaactcaagtgac

SEQ ID NO: 313 - DNA, 16 bp, synthetic construct
  misc_feature 1..16: note = Oligonucleotide motif
  source 1..16: mol_type = other DNA
tcctttacttagctag

SEQ ID NO: 314 - DNA, 16 bp, synthetic construct
  misc_feature 1..16: note = Oligonucleotide motif
  source 1..16: mol_type = other DNA
gagtttggattagctg

SEQ ID NO: 315 - DNA, 16 bp, synthetic construct
  misc_feature 1..16: note = Oligonucleotide motif
  source 1..16: mol_type = other DNA
tgggatatgacaggga

SEQ ID NO: 316 - DNA, 16 bp, synthetic construct
  misc_feature 1..16: note = Oligonucleotide motif
  source 1..16: mol_type = other DNA
tgtgggatatgacagg

SEQ ID NO: 317 - DNA, 16 bp, synthetic construct
  misc_feature 1..16: note = Oligonucleotide motif
  source 1..16: mol_type = other DNA
atatggaagggatatc

SEQ ID NO: 318 - DNA, 16 bp, synthetic construct
  misc_feature 1..16: note = Oligonucleotide motif
  source 1..16: mol_type = other DNA
acaggatatggaaggg

SEQ ID NO: 319 - DNA, 17 bp, synthetic construct
  misc_feature 1..17: note = Oligonucleotide motif
  source 1..17: mol_type = other DNA
atttcaacaggatatgg

SEQ ID NO: 320 - DNA, 16 bp, synthetic construct
  misc_feature 1..16: note = Oligonucleotide motif
  source 1..16: mol_type = other DNA
gagtaatttcaacagg

SEQ ID NO: 321 - DNA, 17 bp, synthetic construct
  misc_feature 1..17: note = Oligonucleotide motif
  source 1..17: mol_type = other DNA
agggagtaatttcaaca

SEQ ID NO: 322 - DNA, 17 bp, synthetic construct
  misc_feature 1..17: note = Oligonucleotide motif
  source 1..17: mol_type = other DNA
attagggagtaatttca

SEQ ID NO: 323 - DNA, 16 bp, synthetic construct
  misc_feature 1..16: note = Oligonucleotide motif
  source 1..16: mol_type = other DNA
cttactattagggagt

SEQ ID NO: 324 - DNA, 16 bp, synthetic construct
  misc_feature 1..16: note = Oligonucleotide motif
  source 1..16: mol_type = other DNA
cagcttactattaggg

SEQ ID NO: 325 - DNA, 16 bp, synthetic construct
  misc_feature 1..16: note = Oligonucleotide motif
  source 1..16: mol_type = other DNA
tcagcttactattagg

SEQ ID NO: 326 - DNA, 18 bp, synthetic construct
  misc_feature 1..18: note = Oligonucleotide motif
  source 1..18: mol_type = other DNA
atttcagcttactattag

SEQ ID NO: 327 - DNA, 16 bp, synthetic construct
  misc_feature 1..16: note = Oligonucleotide motif
  source 1..16: mol_type = other DNA
ttcagcttactattag

SEQ ID NO: 328 - DNA, 16 bp, synthetic construct
  misc_feature 1..16: note = Oligonucleotide motif
  source 1..16: mol_type = other DNA
cagatttcagcttact

SEQ ID NO: 329 - DNA, 16 bp, synthetic construct
  misc_feature 1..16: note = Oligonucleotide motif
  source 1..16: mol_type = other DNA
gactacaactagaggg

SEQ ID NO: 330 - DNA, 16 bp, synthetic construct
  misc_feature 1..16: note = Oligonucleotide motif
  source 1..16: mol_type = other DNA
agactacaactagagg

SEQ ID NO: 331 - DNA, 16 bp, synthetic construct
  misc_feature 1..16: note = Oligonucleotide motif
  source 1..16: mol_type = other DNA
aagactacaactagag

SEQ ID NO: 332 - DNA, 20 bp, synthetic construct
  misc_feature 1..20: note = Oligonucleotide motif
  source 1..20: mol_type = other DNA
atgatttaattctagtcaaa

SEQ ID NO: 333 - DNA, 16 bp, synthetic construct
  misc_feature 1..16: note = Oligonucleotide motif
  source 1..16: mol_type = other DNA
tttaattctagtcaaa

SEQ ID NO: 334 - DNA, 16 bp, synthetic construct
  misc_feature 1..16: note = Oligonucleotide motif
  source 1..16: mol_type = other DNA
gatttaattctagtca

SEQ ID NO: 335 - DNA, 18 bp, synthetic construct
  misc_feature 1..18: note = Oligonucleotide motif
  source 1..18: mol_type = other DNA
atgatttaattctagtca

SEQ ID NO: 336 - DNA, 19 bp, synthetic construct
  misc_feature 1..19: note = Oligonucleotide motif
  source 1..19: mol_type = other DNA
gatgatttaattctagtca

SEQ ID NO: 337 - DNA, 16 bp, synthetic construct
  misc_feature 1..16: note = Oligonucleotide motif
  source 1..16: mol_type = other DNA
gatttaattctagtca

SEQ ID NO: 338 - DNA, 18 bp, synthetic construct
  misc_feature 1..18: note = Oligonucleotide motif
  source 1..18: mol_type = other DNA
gatgatttaattctagtc

SEQ ID NO: 339 - DNA, 16 bp, synthetic construct
  misc_feature 1..16: note = Oligonucleotide motif
  source 1..16: mol_type = other DNA
tgatttaattctagtc

SEQ ID NO: 340 - DNA, 17 bp, synthetic construct
  misc_feature 1..17: note = Oligonucleotide motif
  source 1..17: mol_type = other DNA
gagatgatttaattcta

SEQ ID NO: 341 - DNA, 16 bp, synthetic construct
  misc_feature 1..16: note = Oligonucleotide motif
  source 1..16: mol_type = other DNA
gagatgatttaattct

SEQ ID NO: 342 - DNA, 16 bp, synthetic construct
  misc_feature 1..16: note = Oligonucleotide motif
  source 1..16: mol_type = other DNA
cagattgatggtagtt

SEQ ID NO: 343 - DNA, 16 bp, synthetic construct
  misc_feature 1..16: note = Oligonucleotide motif
  source 1..16: mol_type = other DNA
ctcagattgatggtag

SEQ ID NO: 344 - DNA, 16 bp, synthetic construct
  misc_feature 1..16: note = Oligonucleotide motif
  source 1..16: mol_type = other DNA
gttagccctcagattg

SEQ ID NO: 345 - DNA, 16 bp, synthetic construct
  misc_feature 1..16: note = Oligonucleotide motif
  source 1..16: mol_type = other DNA
tgtattgttagccctc

SEQ ID NO: 346 - DNA, 16 bp, synthetic construct
  misc_feature 1..16: note = Oligonucleotide motif
  source 1..16: mol_type = other DNA
acttgtattgttagcc

SEQ ID NO: 347 - DNA, 16 bp, synthetic construct
  misc_feature 1..16: note = Oligonucleotide motif
  source 1..16: mol_type = other DNA
agccagtatcagggac

SEQ ID NO: 348 - DNA, 16 bp, synthetic construct
  misc_feature 1..16: note = Oligonucleotide motif
  source 1..16: mol_type = other DNA
ttgacaatagtggcat

SEQ ID NO: 349 - DNA, 16 bp, synthetic construct
  misc_feature 1..16: note = Oligonucleotide motif
  source 1..16: mol_type = other DNA
acaagtggtatcttct

SEQ ID NO: 350 - DNA, 16 bp, synthetic construct
  misc_feature 1..16: note = Oligonucleotide motif
  source 1..16: mol_type = other DNA
aatctactttacaagt

SEQ ID NO: 351 - DNA, 18 bp, synthetic construct
  misc_feature 1..18: note = Oligonucleotide motif
  source 1..18: mol_type = other DNA
cacagtagatgcctgata

SEQ ID NO: 352 - DNA, 16 bp, synthetic construct
  misc_feature 1..16: note = Oligonucleotide motif
  source 1..16: mol_type = other DNA
gaacacagtagatgcc

SEQ ID NO: 353 - DNA, 17 bp, synthetic construct
  misc_feature 1..17: note = Oligonucleotide motif
  source 1..17: mol_type = other DNA
cttggaacacagtagat

SEQ ID NO: 354 - DNA, 16 bp, synthetic construct
  misc_feature 1..16: note = Oligonucleotide motif
  source 1..16: mol_type = other DNA
atatcttggaacacag

SEQ ID NO: 355 - DNA, 18 bp, synthetic construct
  misc_feature 1..18: note = Oligonucleotide motif
  source 1..18: mol_type = other DNA
tctttaatatcttggaac

SEQ ID NO: 356 - DNA, 19 bp, synthetic construct
  misc_feature 1..19: note = Oligonucleotide motif
  source 1..19: mol_type = other DNA
tgatttctttaatatcttg

SEQ ID NO: 357 - DNA, 19 bp, synthetic construct
  misc_feature 1..19: note = Oligonucleotide motif
  source 1..19: mol_type = other DNA
tgatgatttctttaatatc

SEQ ID NO: 358 - DNA, 16 bp, synthetic construct
  misc_feature 1..16: note = Oligonucleotide motif
  source 1..16: mol_type = other DNA
aggctaagtcatgatg

SEQ ID NO: 359 - DNA, 16 bp, synthetic construct
  misc_feature 1..16: note = Oligonucleotide motif
  source 1..16: mol_type = other DNA
ttgatgaggctaagtc

SEQ ID NO: 360 - DNA, 16 bp, synthetic construct
  misc_feature 1..16: note = Oligonucleotide motif
  source 1..16: mol_type = other DNA
ccaggattatactctt

SEQ ID NO: 361 - DNA, 16 bp, synthetic construct
  misc_feature 1..16: note = Oligonucleotide motif
  source 1..16: mol_type = other DNA
gccaggattatactct

SEQ ID NO: 362 - DNA, 16 bp, synthetic construct
  misc_feature 1..16: note = Oligonucleotide motif
  source 1..16: mol_type = other DNA
ctgccaggattatact

SEQ ID NO: 363 - DNA, 19 bp, synthetic construct
  misc_feature 1..19: note = Oligonucleotide motif
  source 1..19: mol_type = other DNA
cagaaacttatactttatg

SEQ ID NO: 364 - DNA, 17 bp, synthetic construct
  misc_feature 1..17: note = Oligonucleotide motif
  source 1..17: mol_type = other DNA
aagcagaaacttatact

SEQ ID NO: 365 - DNA, 18 bp, synthetic construct
  misc_feature 1..18: note = Oligonucleotide motif
  source 1..18: mol_type = other DNA
gaagcagaaacttatact

SEQ ID NO: 366 - DNA, 20 bp, synthetic construct
  misc_feature 1..20: note = Oligonucleotide motif
  source 1..20: mol_type = other DNA
tggaagcagaaacttatact

SEQ ID NO: 367 - DNA, 19 bp, synthetic construct
  misc_feature 1..19: note = Oligonucleotide motif
  source 1..19: mol_type = other DNA
tggaagcagaaacttatac

SEQ ID NO: 368 - DNA, 16 bp, synthetic construct
  misc_feature 1..16: note = Oligonucleotide motif
  source 1..16: mol_type = other DNA
aagcagaaacttatac

SEQ ID NO: 369 - DNA, 18 bp, synthetic construct
  misc_feature 1..18: note = Oligonucleotide motif
  source 1..18: mol_type = other DNA
tggaagcagaaacttata

SEQ ID NO: 370 - DNA, 16 bp, synthetic construct
  misc_feature 1..16: note = Oligonucleotide motif
  source 1..16: mol_type = other DNA
aagggatattatggag

SEQ ID NO: 371 - DNA, 16 bp, synthetic construct
  misc_feature 1..16: note = Oligonucleotide motif
  source 1..16: mol_type = other DNA
tgccggaagatttcct

SEQ ID NO: 372 - DNA, 16 bp, synthetic construct
  misc_feature 1..16: note = Oligonucleotide motif
  source 1..16: mol_type = other DNA
atggattgggagtaga

SEQ ID NO: 373 - DNA, 16 bp, synthetic construct
  misc_feature 1..16: note = Oligonucleotide motif
  source 1..16: mol_type = other DNA
agatggattgggagta

SEQ ID NO: 374 - DNA, 16 bp, synthetic construct
  misc_feature 1..16: note = Oligonucleotide motif
  source 1..16: mol_type = other DNA
aagatggattgggagt

SEQ ID NO: 375 - DNA, 16 bp, synthetic construct
  misc_feature 1..16: note = Oligonucleotide motif
  source 1..16: mol_type = other DNA
acaagatggattggga

SEQ ID NO: 376 - DNA, 16 bp, synthetic construct
  misc_feature 1..16: note = Oligonucleotide motif
  source 1..16: mol_type = other DNA
agaaggttcagacttt

SEQ ID NO: 377 - DNA, 16 bp, synthetic construct
  misc_feature 1..16: note = Oligonucleotide motif
  source 1..16: mol_type = other DNA
gcagaaggttcagact

SEQ ID NO: 378 - DNA, 16 bp, synthetic construct
  misc_feature 1..16: note = Oligonucleotide motif
  source 1..16: mol_type = other DNA
tgcagaaggttcagac

SEQ ID NO: 379 - DNA, 16 bp, synthetic construct
  misc_feature 1..16: note = Oligonucleotide motif
  source 1..16: mol_type = other DNA
agtgcagaaggttcag

SEQ ID NO: 380 - DNA, 16 bp, synthetic construct
  misc_feature 1..16: note = Oligonucleotide motif
  source 1..16: mol_type = other DNA
aagtgcagaaggttca

SEQ ID NO: 381 - DNA, 16 bp, synthetic construct
  misc_feature 1..16: note = Oligonucleotide motif
  source 1..16: mol_type = other DNA
taagtgcagaaggttc

SEQ ID NO: 382 - DNA, 16 bp, synthetic construct
  misc_feature 1..16: note = Oligonucleotide motif
  source 1..16: mol_type = other DNA
tctaagtgcagaaggt

SEQ ID NO: 383 - DNA, 17 bp, synthetic construct
  misc_feature 1..17: note = Oligonucleotide motif
  source 1..17: mol_type = other DNA
ctcaggagttctacttc

SEQ ID NO: 384 - DNA, 16 bp, synthetic construct
  misc_feature 1..16: note = Oligonucleotide motif
  source 1..16: mol_type = other DNA
ctcaggagttctactt

SEQ ID NO: 385 - DNA, 18 bp, synthetic construct
  misc_feature 1..18: note = Oligonucleotide motif
  source 1..18: mol_type = other DNA
atggaggtgactcaggag

SEQ ID NO: 386 - DNA, 17 bp, synthetic construct
  misc_feature 1..17: note = Oligonucleotide motif
  source 1..17: mol_type = other DNA
atggaggtgactcagga

SEQ ID NO: 387 - DNA, 16 bp, synthetic construct
  misc_feature 1..16: note = Oligonucleotide motif
  source 1..16: mol_type = other DNA
atggaggtgactcagg

SEQ ID NO: 388 - DNA, 17 bp, synthetic construct
  misc_feature 1..17: note = Oligonucleotide motif
  source 1..17: mol_type = other DNA
tatggaggtgactcagg

SEQ ID NO: 389 - DNA, 18 bp, synthetic construct
  misc_feature 1..18: note = Oligonucleotide motif
  source 1..18: mol_type = other DNA
atatggaggtgactcagg

SEQ ID NO: 390 - DNA, 16 bp, synthetic construct
  misc_feature 1..16: note = Oligonucleotide motif
  source 1..16: mol_type = other DNA
tatggaggtgactcag

SEQ ID NO: 391 - DNA, 17 bp, synthetic construct
  misc_feature 1..17: note = Oligonucleotide motif
  source 1..17: mol_type = other DNA
atatggaggtgactcag

SEQ ID NO: 392 - DNA, 18 bp, synthetic construct
  misc_feature 1..18: note = Oligonucleotide motif
  source 1..18: mol_type = other DNA
catatggaggtgactcag

SEQ ID NO: 393 - DNA, 16 bp, synthetic construct
  misc_feature 1..16: note = Oligonucleotide motif
  source 1..16: mol_type = other DNA
atatggaggtgactca

SEQ ID NO: 394 - DNA, 17 bp, synthetic construct
  misc_feature 1..17: note = Oligonucleotide motif
  source 1..17: mol_type = other DNA
catatggaggtgactca

SEQ ID NO: 395 - DNA, 16 bp, synthetic construct
  misc_feature 1..16: note = Oligonucleotide motif
  source 1..16: mol_type = other DNA
catatggaggtgactc

SEQ ID NO: 396 - DNA, 17 bp, synthetic construct
  misc_feature 1..17: note = Oligonucleotide motif
  source 1..17: mol_type = other DNA
gcatatggaggtgactc

SEQ ID NO: 397 - DNA, 18 bp, synthetic construct
  misc_feature 1..18: note = Oligonucleotide motif
  source 1..18: mol_type = other DNA
tgcatatggaggtgactc

SEQ ID NO: 398 - DNA, 19 bp, synthetic construct
  misc_feature 1..19: note = Oligonucleotide motif
  source 1..19: mol_type = other DNA
ttgcatatggaggtgactc

SEQ ID NO: 399 - DNA, 20 bp, synthetic construct
  misc_feature 1..20: note = Oligonucleotide motif
  source 1..20: mol_type = other DNA
tttgcatatggaggtgactc

SEQ ID NO: 400 - DNA, 16 bp, synthetic construct
  misc_feature 1..16: note = Oligonucleotide motif
  source 1..16: mol_type = other DNA
gcatatggaggtgact

SEQ ID NO: 401 - DNA, 17 bp, synthetic construct
  misc_feature 1..17: note = Oligonucleotide motif
  source 1..17: mol_type = other DNA
tgcatatggaggtgact

SEQ ID NO: 402 - DNA, 18 bp, synthetic construct
  misc_feature 1..18: note = Oligonucleotide motif
  source 1..18: mol_type = other DNA
ttgcatatggaggtgact

SEQ ID NO: 403 - DNA, 19 bp, synthetic construct
  misc_feature 1..19: note = Oligonucleotide motif
  source 1..19: mol_type = other DNA
tttgcatatggaggtgact

SEQ ID NO: 404 - DNA, 16 bp, synthetic construct
  misc_feature 1..16: note = Oligonucleotide motif
  source 1..16: mol_type = other DNA
tgcatatggaggtgac

SEQ ID NO: 405 - DNA, 17 bp, synthetic construct
  misc_feature 1..17: note = Oligonucleotide motif
  source 1..17: mol_type = other DNA
ttgcatatggaggtgac

SEQ ID NO: 406 - DNA, 18 bp, synthetic construct
  misc_feature 1..18: note = Oligonucleotide motif
  source 1..18: mol_type = other DNA
tttgcatatggaggtgac

SEQ ID NO: 407 - DNA, 17 bp, synthetic construct
  misc_feature 1..17: note = Oligonucleotide motif
  source 1..17: mol_type = other DNA
tttgcatatggaggtga

SEQ ID NO: 408 - DNA, 16 bp, synthetic construct
  misc_feature 1..16: note = Oligonucleotide motif
  source 1..16: mol_type = other DNA
tttgcatatggaggtg

SEQ ID NO: 409 - DNA, 17 bp, synthetic construct
  misc_feature 1..17: note = Oligonucleotide motif
  source 1..17: mol_type = other DNA
aagtgaagttcaacagc

SEQ ID NO: 410 - DNA, 16 bp, synthetic construct
  misc_feature 1..16: note = Oligonucleotide motif
  source 1..16: mol_type = other DNA
tgggaagtgaagttca

SEQ ID NO: 411 - DNA, 16 bp, synthetic construct
  misc_feature 1..16: note = Oligonucleotide motif
  source 1..16: mol_type = other DNA
atgggaagtgaagttc

SEQ ID NO: 412 - DNA, 16 bp, synthetic construct
  misc_feature 1..16: note = Oligonucleotide motif
  source 1..16: mol_type = other DNA
gatgggaagtgaagtt

SEQ ID NO: 413 - DNA, 17 bp, synthetic construct
  misc_feature 1..17: note = Oligonucleotide motif
  source 1..17: mol_type = other DNA
ctgtgatgggaagtgaa

SEQ ID NO: 414 - DNA, 16 bp, synthetic construct
  misc_feature 1..16: note = Oligonucleotide motif
  source 1..16: mol_type = other DNA
attgagtgaatccaaa

SEQ ID NO: 415 - DNA, 16 bp, synthetic construct
  misc_feature 1..16: note = Oligonucleotide motif
  source 1..16: mol_type = other DNA
aattgagtgaatccaa

SEQ ID NO: 416 - DNA, 17 bp, synthetic construct
  misc_feature 1..17: note = Oligonucleotide motif
  source 1..17: mol_type = other DNA
gataattgagtgaatcc

SEQ ID NO: 417 - DNA, 16 bp, synthetic construct
  misc_feature 1..16: note = Oligonucleotide motif
  source 1..16: mol_type = other DNA
gtgataattgagtgaa

SEQ ID NO: 418 - DNA, 16 bp, synthetic construct
  misc_feature 1..16: note = Oligonucleotide motif
  source 1..16: mol_type = other DNA
aagaaaggtgcaataa

SEQ ID NO: 419 - DNA, 16 bp, synthetic construct
  misc_feature 1..16: note = Oligonucleotide motif
  source 1..16: mol_type = other DNA
caagaaaggtgcaata

SEQ ID NO: 420 - DNA, 16 bp, synthetic construct
  misc_feature 1..16: note = Oligonucleotide motif
  source 1..16: mol_type = other DNA
acaagaaaggtgcaat

SEQ ID NO: 421 - DNA, 16 bp, synthetic construct
  misc_feature 1..16: note = Oligonucleotide motif
  source 1..16: mol_type = other DNA
atttaaactcacaaac

SEQ ID NO: 422 - DNA, 16 bp, synthetic construct
  misc_feature 1..16: note = Oligonucleotide motif
  source 1..16: mol_type = other DNA
ctgttaggttcagcga

SEQ ID NO: 423 - DNA, 17 bp, synthetic construct
  misc_feature 1..17: note = Oligonucleotide motif
  source 1..17: mol_type = other DNA
tctgaatgaacatttcg

SEQ ID NO: 424 - DNA, 16 bp, synthetic construct
  misc_feature 1..16: note = Oligonucleotide motif
  source 1..16: mol_type = other DNA
ctcattgaaggttctg

SEQ ID NO: 425 - DNA, 16 bp, synthetic construct
  misc_feature 1..16: note = Oligonucleotide motif
  source 1..16: mol_type = other DNA
ctaatctcattgaagg

SEQ ID NO: 426 - DNA, 16 bp, synthetic construct
  misc_feature 1..16: note = Oligonucleotide motif
  source 1..16: mol_type = other DNA
cctaatctcattgaag

SEQ ID NO: 427 - DNA, 16 bp, synthetic construct
  misc_feature 1..16: note = Oligonucleotide motif
  source 1..16: mol_type = other DNA
actttgatctttcagc

SEQ ID NO: 428 - DNA, 16 bp, synthetic construct
  misc_feature 1..16: note = Oligonucleotide motif
  source 1..16: mol_type = other DNA
actatgcaacactttg

SEQ ID NO: 429 - DNA, 16 bp, synthetic construct
  misc_feature 1..16: note = Oligonucleotide motif
  source 1..16: mol_type = other DNA
caaatagctttatcgg

SEQ ID NO: 430 - DNA, 16 bp, synthetic construct
  misc_feature 1..16: note = Oligonucleotide motif
  source 1..16: mol_type = other DNA
ccaaatagctttatcg

SEQ ID NO: 431 - DNA, 16 bp, synthetic construct
  misc_feature 1..16: note = Oligonucleotide motif
  source 1..16: mol_type = other DNA
tccaaatagctttatc

SEQ ID NO: 432 - DNA, 16 bp, synthetic construct
  misc_feature 1..16: note = Oligonucleotide motif
  source 1..16: mol_type = other DNA
gatccaaatagcttta

SEQ ID NO: 433 - DNA, 16 bp, synthetic construct
  misc_feature 1..16: note = Oligonucleotide motif
  source 1..16: mol_type = other DNA
atgatccaaatagctt

SEQ ID NO: 434 - DNA, 16 bp, synthetic construct
  misc_feature 1..16: note = Oligonucleotide motif
  source 1..16: mol_type = other DNA
tatgatccaaatagct

SEQ ID NO: 435 - DNA, 17 bp, synthetic construct
  misc_feature 1..17: note = Oligonucleotide motif
  source 1..17: mol_type = other DNA
taaacagggctgggaat

SEQ ID NO: 436 - DNA, 16 bp, synthetic construct
  misc_feature 1..16: note = Oligonucleotide motif
  source 1..16: mol_type = other DNA
acttaaacagggctgg

SEQ ID NO: 437 - DNA, 16 bp, synthetic construct
  misc_feature 1..16: note = Oligonucleotide motif
  source 1..16: mol_type = other DNA
acacttaaacagggct

SEQ ID NO: 438 - DNA, 16 bp, synthetic construct
  misc_feature 1..16: note = Oligonucleotide motif
  source 1..16: mol_type = other DNA
gaacacttaaacaggg

SEQ ID NO: 439 - DNA, 17 bp, synthetic construct
  misc_feature 1..17: note = Oligonucleotide motif
  source 1..17: mol_type = other DNA
agagaacacttaaacag

SEQ ID NO: 440 - DNA, 16 bp, synthetic construct
  misc_feature 1..16: note = Oligonucleotide motif
  source 1..16: mol_type = other DNA
ctacagagaacactta

SEQ ID NO: 441 - DNA, 17 bp, synthetic construct
  misc_feature 1..17: note = Oligonucleotide motif
  source 1..17: mol_type = other DNA
atgctacagagaacact

SEQ ID NO: 442 - DNA, 19 bp, synthetic construct
  misc_feature 1..19: note = Oligonucleotide motif
  source 1..19: mol_type = other DNA
ataaatgctacagagaaca

SEQ ID NO: 443 - DNA, 18 bp, synthetic construct
  misc_feature 1..18: note = Oligonucleotide motif
  source 1..18: mol_type = other DNA
agataaatgctacagaga

SEQ ID NO: 444 - DNA, 17 bp, synthetic construct
  misc_feature 1..17: note = Oligonucleotide motif
  source 1..17: mol_type = other DNA
tagagataaatgctaca

SEQ ID NO: 445 - DNA, 18 bp, synthetic construct
  misc_feature 1..18: note = Oligonucleotide motif
  source 1..18: mol_type = other DNA
tagatagagataaatgct

SEQ ID NO: 446 - DNA, 18 bp, synthetic construct
  misc_feature 1..18: note = Oligonucleotide motif
  source 1..18: mol_type = other DNA
caatatactagatagaga

SEQ ID NO: 447 - DNA, 19 bp, synthetic construct
  misc_feature 1..19: note = Oligonucleotide motif
  source 1..19: mol_type = other DNA
tacacaatatactagatag

SEQ ID NO: 448 - DNA, 16 bp, synthetic construct
  misc_feature 1..16: note = Oligonucleotide motif
  source 1..16: mol_type = other DNA
ctacacaatatactag

SEQ ID NO: 449 - DNA, 16 bp, synthetic construct
  misc_feature 1..16: note = Oligonucleotide motif
  source 1..16: mol_type = other DNA
gctacacaatatacta

SEQ ID NO: 450 - DNA, 18 bp, synthetic construct
  misc_feature 1..18: note = Oligonucleotide motif
  source 1..18: mol_type = other DNA
atatgctacacaatatac

SEQ ID NO: 451 - DNA, 16 bp, synthetic construct
  misc_feature 1..16: note = Oligonucleotide motif
  source 1..16: mol_type = other DNA
tgatatgctacacaat

SEQ ID NO: 452 - DNA, 17 bp, synthetic construct
  misc_feature 1..17: note = Oligonucleotide motif
  source 1..17: mol_type = other DNA
atgatatgatatgctac

SEQ ID NO: 453 - DNA, 18 bp, synthetic construct
  misc_feature 1..18: note = Oligonucleotide motif
  source 1..18: mol_type = other DNA
gaggagagagacaataaa

SEQ ID NO: 454 - DNA, 17 bp, synthetic construct
  misc_feature 1..17: note = Oligonucleotide motif
  source 1..17: mol_type = other DNA
ctaggaggagagagaca

SEQ ID NO: 455 - DNA, 17 bp, synthetic construct
  misc_feature 1..17: note = Oligonucleotide motif
  source 1..17: mol_type = other DNA
tattctaggaggagaga

SEQ ID NO: 456 - DNA, 17 bp, synthetic construct
  misc_feature 1..17: note = Oligonucleotide motif
  source 1..17: mol_type = other DNA
ttatattctaggaggag

SEQ ID NO: 457 - DNA, 16 bp, synthetic construct
  misc_feature 1..16: note = Oligonucleotide motif
  source 1..16: mol_type = other DNA
gtttatattctaggag

SEQ ID NO: 458 - DNA, 18 bp, synthetic construct
  misc_feature 1..18: note = Oligonucleotide motif
  source 1..18: mol_type = other DNA
tggagtttatattctagg

SEQ ID NO: 459 - DNA, 16 bp, synthetic construct
  misc_feature 1..16: note = Oligonucleotide motif
  source 1..16: mol_type = other DNA
cgtaccaccactctgc

SEQ ID NO: 460 - DNA, 18 bp, synthetic construct
  misc_feature 1..18: note = Oligonucleotide motif
  source 1..18: mol_type = other DNA
tgaggaaatcattcattc

SEQ ID NO: 461 - DNA, 18 bp, synthetic construct
  misc_feature 1..18: note = Oligonucleotide motif
  source 1..18: mol_type = other DNA
tttgaggaaatcattcat

SEQ ID NO: 462 - DNA, 16 bp, synthetic construct
  misc_feature 1..16: note = Oligonucleotide motif
  source 1..16: mol_type = other DNA
aggctaatcctatttg

SEQ ID NO: 463 - DNA, 16 bp, synthetic construct
  misc_feature 1..16: note = Oligonucleotide motif
  source 1..16: mol_type = other DNA
tttaggctaatcctat

SEQ ID NO: 464 - DNA, 16 bp, synthetic construct
  misc_feature 1..16: note = Oligonucleotide motif
  source 1..16: mol_type = other DNA
tgctccagtgtaccct

SEQ ID NO: 465 - DNA, 16 bp, synthetic construct
  misc_feature 1..16: note = Oligonucleotide motif
  source 1..16: mol_type = other DNA
tagtagtactcgatag

SEQ ID NO: 466 - DNA, 18 bp, synthetic construct
  misc_feature 1..18: note = Oligonucleotide motif
  source 1..18: mol_type = other DNA
ctaattgtagtagtactc

SEQ ID NO: 467 - DNA, 16 bp, synthetic construct
  misc_feature 1..16: note = Oligonucleotide motif
  source 1..16: mol_type = other DNA
tgctaattgtagtagt

SEQ ID NO: 468 - DNA, 16 bp, synthetic construct
  misc_feature 1..16: note = Oligonucleotide motif
  source 1..16: mol_type = other DNA
agtgctaattgtagta

SEQ ID NO: 469 - DNA, 16 bp, synthetic construct
  misc_feature 1..16: note = Oligonucleotide motif
  source 1..16: mol_type = other DNA
gcaagtgctaattgta

SEQ ID NO: 470 - DNA, 19 bp, synthetic construct
  misc_feature 1..19: note = Oligonucleotide motif
  source 1..19: mol_type = other DNA
gaggaaatgaactaattta

SEQ ID NO: 471 - DNA, 17 bp, synthetic construct
  misc_feature 1..17: note = Oligonucleotide motif
  source 1..17: mol_type = other DNA
caggaggaaatgaacta

SEQ ID NO: 472 - DNA, 16 bp, synthetic construct
  misc_feature 1..16: note = Oligonucleotide motif
  source 1..16: mol_type = other DNA
ccctagagtcatttcc

SEQ ID NO: 473 - DNA, 17 bp, synthetic construct
  misc_feature 1..17: note = Oligonucleotide motif
  source 1..17: mol_type = other DNA
atcttacatgatgaagc

SEQ ID NO: 474 - DNA, 18 bp, synthetic construct
  misc_feature 1..18: note = Oligonucleotide motif
  source 1..18: mol_type = other DNA
gacacactcagatttcag

SEQ ID NO: 475 - DNA, 19 bp, synthetic construct
  misc_feature 1..19: note = Oligonucleotide motif
  source 1..19: mol_type = other DNA
agacacactcagatttcag

SEQ ID NO: 476 - DNA, 20 bp, synthetic construct
  misc_feature 1..20: note = Oligonucleotide motif
  source 1..20: mol_type = other DNA
aagacacactcagatttcag

SEQ ID NO: 477 - DNA, 18 bp, synthetic construct
  misc_feature 1..18: note = Oligonucleotide motif
  source 1..18: mol_type = other DNA
agacacactcagatttca

SEQ ID NO: 478 - DNA, 19 bp, synthetic construct
  misc_feature 1..19: note = Oligonucleotide motif
  source 1..19: mol_type = other DNA
aagacacactcagatttca

SEQ ID NO: 479 - DNA, 20 bp, synthetic construct
  misc_feature 1..20: note = Oligonucleotide motif
  source 1..20: mol_type = other DNA
aaagacacactcagatttca

SEQ ID NO: 480 - DNA, 20 bp, synthetic construct
  misc_feature 1..20: note = Oligonucleotide motif
  source 1..20: mol_type = other DNA
gaaagacacactcagatttc

SEQ ID NO: 481 - DNA, 18 bp, synthetic construct
  misc_feature 1..18: note = Oligonucleotide motif
  source 1..18: mol_type = other DNA
aagacacactcagatttc

SEQ ID NO: 482 - DNA, 19 bp, synthetic construct
  misc_feature 1..19: note = Oligonucleotide motif
  source 1..19: mol_type = other DNA
aaagacacactcagatttc

SEQ ID NO: 483 - DNA, 20 bp, synthetic construct
  misc_feature 1..20: note = Oligonucleotide motif
  source 1..20: mol_type = other DNA
tgaaagacacactcagattt

SEQ ID NO: 484 - DNA, 19 bp, synthetic construct
  misc_feature 1..19: note = Oligonucleotide motif
  source 1..19: mol_type = other DNA
tgaaagacacactcagatt

SEQ ID NO: 485 - DNA, 18 bp, synthetic construct
  misc_feature 1..18: note = Oligonucleotide motif
  source 1..18: mol_type = other DNA
tgaaagacacactcagat

SEQ ID NO: 486 - DNA, 17 bp, synthetic construct
  misc_feature 1..17: note = Oligonucleotide motif
  source 1..17: mol_type = other DNA
attgaaagacacactca

SEQ ID NO: 487 - DNA, 17 bp, synthetic construct
  misc_feature 1..17: note = Oligonucleotide motif
  source 1..17: mol_type = other DNA
tcattgaaagacacact

SEQ ID NO: 488 - DNA, 16 bp, synthetic construct
  misc_feature 1..16: note = Oligonucleotide motif
  source 1..16: mol_type = other DNA
ttccatcattgaaaga

SEQ ID NO: 489 - DNA, 17 bp, synthetic construct
  misc_feature 1..17: note = Oligonucleotide motif
  source 1..17: mol_type = other DNA
ataataccacttatcat

SEQ ID NO: 490 - DNA, 18 bp, synthetic construct
  misc_feature 1..18: note = Oligonucleotide motif
  source 1..18: mol_type = other DNA
ttacttaatttctttgga

SEQ ID NO: 491 - DNA, 18 bp, synthetic construct
  misc_feature 1..18: note = Oligonucleotide motif
  source 1..18: mol_type = other DNA
ttagaactagctttatca

SEQ ID NO: 492 - DNA, 16 bp, synthetic construct
  misc_feature 1..16: note = Oligonucleotide motif
  source 1..16: mol_type = other DNA
gaggtacaaatatagg

SEQ ID NO: 493 - DNA, 16 bp, synthetic construct
  misc_feature 1..16: note = Oligonucleotide motif
  source 1..16: mol_type = other DNA
cttatgatacaactta

SEQ ID NO: 494 - DNA, 16 bp, synthetic construct
  misc_feature 1..16: note = Oligonucleotide motif
  source 1..16: mol_type = other DNA
tcttatgatacaactt

SEQ ID NO: 495 - DNA, 16 bp, synthetic construct
  misc_feature 1..16: note = Oligonucleotide motif
  source 1..16: mol_type = other DNA
ttcttatgatacaact

SEQ ID NO: 496 - DNA, 16 bp, synthetic construct
  misc_feature 1..16: note = Oligonucleotide motif
  source 1..16: mol_type = other DNA
cagtttcttatgatac

SEQ ID NO: 497 - DNA, 16 bp, synthetic construct
  misc_feature 1..16: note = Oligonucleotide motif
  source 1..16: mol_type = other DNA
gcagtttcttatgata

SEQ ID NO: 498 - DNA, 19 bp, synthetic construct
  misc_feature 1..19: note = Oligonucleotide motif
  source 1..19: mol_type = other DNA
tacaaatgtctattaggtt

SEQ ID NO: 499 - DNA, 18 bp, synthetic construct
  misc_feature 1..18: note = Oligonucleotide motif
  source 1..18: mol_type = other DNA
tgtacaaatgtctattag

SEQ ID NO: 500 - DNA, 16 bp, synthetic construct
  misc_feature 1..16: note = Oligonucleotide motif
  source 1..16: mol_type = other DNA
agcatcacaattagta

SEQ ID NO: 501 - DNA, 16 bp, synthetic construct
  misc_feature 1..16: note = Oligonucleotide motif
  source 1..16: mol_type = other DNA
ctaatgatagtgaagc

SEQ ID NO: 502 - DNA, 16 bp, synthetic construct
  misc_feature 1..16: note = Oligonucleotide motif
  source 1..16: mol_type = other DNA
agctaatgatagtgaa

SEQ ID NO: 503 - DNA, 16 bp, synthetic construct
  misc_feature 1..16: note = Oligonucleotide motif
  source 1..16: mol_type = other DNA
atgccttgacatatta

SEQ ID NO: 504 - DNA, 17 bp, synthetic construct
  misc_feature 1..17: note = Oligonucleotide motif
  source 1..17: mol_type = other DNA
ctcaagattattgacac

SEQ ID NO: 505 - DNA, 16 bp, synthetic construct
  misc_feature 1..16: note = Oligonucleotide motif
  source 1..16: mol_type = other DNA
acctcaagattattga

SEQ ID NO: 506 - DNA, 16 bp, synthetic construct
  misc_feature 1..16: note = Oligonucleotide motif
  source 1..16: mol_type = other DNA
aacctcaagattattg

SEQ ID NO: 507 - DNA, 19 bp, synthetic construct
  misc_feature 1..19: note = Oligonucleotide motif
  source 1..19: mol_type = other DNA
cacaaacctcaagattatt

SEQ ID NO: 508 - DNA, 16 bp, synthetic construct
  misc_feature 1..16: note = Oligonucleotide motif
  source 1..16: mol_type = other DNA
gtacttaattagacct

SEQ ID NO: 509 - DNA, 16 bp, synthetic construct
  misc_feature 1..16: note = Oligonucleotide motif
  source 1..16: mol_type = other DNA
agtacttaattagacc

SEQ ID NO: 510 - DNA, 16 bp, synthetic construct
  misc_feature 1..16: note = Oligonucleotide motif
  source 1..16: mol_type = other DNA
gtatgaggtggtaaac

SEQ ID NO: 511 - DNA, 17 bp, synthetic construct
  misc_feature 1..17: note = Oligonucleotide motif
  source 1..17: mol_type = other DNA
aggaaacagcagaagtg

SEQ ID NO: 512 - DNA, 16 bp, synthetic construct
  misc_feature 1..16: note = Oligonucleotide motif
  source 1..16: mol_type = other DNA
gcacaacccagaggaa

SEQ ID NO: 513 - DNA, 16 bp, synthetic construct
  misc_feature 1..16: note = Oligonucleotide motif
  source 1..16: mol_type = other DNA
caagcacaacccagag

SEQ ID NO: 514 - DNA, 16 bp, synthetic construct
  misc_feature 1..16: note = Oligonucleotide motif
  source 1..16: mol_type = other DNA
ttcaagcacaacccag

SEQ ID NO: 515 - DNA, 16 bp, synthetic construct
  misc_feature 1..16: note = Oligonucleotide motif
  source 1..16: mol_type = other DNA
aattcaagcacaaccc

SEQ ID NO: 516 - DNA, 19 bp, synthetic construct
  misc_feature 1..19: note = Oligonucleotide motif
  source 1..19: mol_type = other DNA
taataattcaagcacaacc

SEQ ID NO: 517 - DNA, 17 bp, synthetic construct
  misc_feature 1..17: note = Oligonucleotide motif
  source 1..17: mol_type = other DNA
actaataattcaagcac

SEQ ID NO: 518 - DNA, 20 bp, synthetic construct
  misc_feature 1..20: note = Oligonucleotide motif
  source 1..20: mol_type = other DNA
ataatactaataattcaagc

SEQ ID NO: 519 - DNA, 16 bp, synthetic construct
  misc_feature 1..16: note = Oligonucleotide motif
  source 1..16: mol_type = other DNA
tagatttgtgaggtaa

SEQ ID NO: 520 - DNA, 16 bp, synthetic construct
  misc_feature 1..16: note = Oligonucleotide motif
  source 1..16: mol_type = other DNA
agccttaattctccat

SEQ ID NO: 521 - DNA, 17 bp, synthetic construct
  misc_feature 1..17: note = Oligonucleotide motif
  source 1..17: mol_type = other DNA
aatgatctagagcctta

SEQ ID NO: 522 - DNA, 16 bp, synthetic construct
  misc_feature 1..16: note = Oligonucleotide motif
  source 1..16: mol_type = other DNA
ctaatgatctagagcc

SEQ ID NO: 523 - DNA, 16 bp, synthetic construct
  misc_feature 1..16: note = Oligonucleotide motif
  source 1..16: mol_type = other DNA
actaatgatctagagc

SEQ ID NO: 524 - DNA, 18 bp, synthetic construct
  misc_feature 1..18: note = Oligonucleotide motif
  source 1..18: mol_type = other DNA
cattaacatgttcttatt

SEQ ID NO: 525 - DNA, 20 bp, synthetic construct
  misc_feature 1..20: note = Oligonucleotide motif
  source 1..20: mol_type = other DNA
acaagtacattaacatgttc

SEQ ID NO: 526 - DNA, 19 bp, synthetic construct
  misc_feature 1..19: note = Oligonucleotide motif
  source 1..19: mol_type = other DNA
ttacaagtacattaacatg

SEQ ID NO: 527 - DNA, 17 bp, synthetic construct
  misc_feature 1..17: note = Oligonucleotide motif
  source 1..17: mol_type = other DNA
gctttattcatgtttat

SEQ ID NO: 528 - DNA, 16 bp, synthetic construct
  misc_feature 1..16: note = Oligonucleotide motif
  source 1..16: mol_type = other DNA
gctttattcatgttta

SEQ ID NO: 529 - DNA, 18 bp, synthetic construct
  misc_feature 1..18: note = Oligonucleotide motif
  source 1..18: mol_type = other DNA
agagctttattcatgttt

SEQ ID NO: 530 - DNA, 18 bp, synthetic construct
  misc_feature 1..18: note = Oligonucleotide motif
  source 1..18: mol_type = other DNA
ataagagctttattcatg

SEQ ID NO: 531 - DNA, 17 bp, synthetic construct
  misc_feature 1..17: note = Oligonucleotide motif
  source 1..17: mol_type = other DNA
cataagagctttattca

SEQ ID NO: 532 - DNA, 16 bp, synthetic construct
  misc_feature 1..16: note = Oligonucleotide motif
  source 1..16: mol_type = other DNA
agcataagagctttat

SEQ ID NO: 533 - DNA, 16 bp, synthetic construct
  misc_feature 1..16: note = Oligonucleotide motif
  source 1..16: mol_type = other DNA
tagattgtttagtgca

SEQ ID NO: 534 - DNA, 16 bp, synthetic construct
  misc_feature 1..16: note = Oligonucleotide motif
  source 1..16: mol_type = other DNA
gtagattgtttagtgc

SEQ ID NO: 535 - DNA, 17 bp, synthetic construct
  misc_feature 1..17: note = Oligonucleotide motif
  source 1..17: mol_type = other DNA
gacaattctagtagatt

SEQ ID NO: 536 - DNA, 16 bp, synthetic construct
  misc_feature 1..16: note = Oligonucleotide motif
  source 1..16: mol_type = other DNA
ctgacaattctagtag

SEQ ID NO: 537 - DNA, 16 bp, synthetic construct
  misc_feature 1..16: note = Oligonucleotide motif
  source 1..16: mol_type = other DNA
gctgacaattctagta

SEQ ID NO: 538 - DNA, 16 bp, synthetic construct
  misc_feature 1..16: note = Oligonucleotide motif
  source 1..16: mol_type = other DNA
aggattaagatacgta

SEQ ID NO: 539 - DNA, 16 bp, synthetic construct
  misc_feature 1..16: note = Oligonucleotide motif
  source 1..16: mol_type = other DNA
caggattaagatacgt

SEQ ID NO: 540 - DNA, 16 bp, synthetic construct
  misc_feature 1..16: note = Oligonucleotide motif
  source 1..16: mol_type = other DNA
tcaggattaagatacg

SEQ ID NO: 541 - DNA, 16 bp, synthetic construct
  misc_feature 1..16: note = Oligonucleotide motif
  source 1..16: mol_type = other DNA
ttcaggattaagatac

SEQ ID NO: 542 - DNA, 18 bp, synthetic construct
  misc_feature 1..18: note = Oligonucleotide motif
  source 1..18: mol_type = other DNA
aggaagaaagtttgattc

SEQ ID NO: 543 - DNA, 18 bp, synthetic construct
  misc_feature 1..18: note = Oligonucleotide motif
  source 1..18: mol_type = other DNA
tcaaggaagaaagtttga

SEQ ID NO: 544 - DNA, 18 bp, synthetic construct
  misc_feature 1..18: note = Oligonucleotide motif
  source 1..18: mol_type = other DNA
ctcaaggaagaaagtttg

SEQ ID NO: 545 - DNA, 17 bp, synthetic construct
  misc_feature 1..17: note = Oligonucleotide motif
  source 1..17: mol_type = other DNA
tgctcaaggaagaaagt

SEQ ID NO: 546 - DNA, 18 bp, synthetic construct
  misc_feature 1..18: note = Oligonucleotide motif
  source 1..18: mol_type = other DNA
aattatgctcaaggaaga

SEQ ID NO: 547 - DNA, 18 bp, synthetic construct
  misc_feature 1..18: note = Oligonucleotide motif
  source 1..18: mol_type = other DNA
taggataccacattatga

SEQ ID NO: 548 - DNA, 20 bp, synthetic construct
  misc_feature 1..20: note = Oligonucleotide motif
  source 1..20: mol_type = other DNA
cataatttattccattcctc

SEQ ID NO: 549 - DNA, 17 bp, synthetic construct
  misc_feature 1..17: note = Oligonucleotide motif
  source 1..17: mol_type = other DNA
tgcataatttattccat

SEQ ID NO: 550 - DNA, 17 bp, synthetic construct
  misc_feature 1..17: note = Oligonucleotide motif
  source 1..17: mol_type = other DNA
actgcataatttattcc

SEQ ID NO: 551 - DNA, 19 bp, synthetic construct
  misc_feature 1..19: note = Oligonucleotide motif
  source 1..19: mol_type = other DNA
ctaaactgcataatttatt

SEQ ID NO: 552 - DNA, 16 bp, synthetic construct
  misc_feature 1..16: note = Oligonucleotide motif
  source 1..16: mol_type = other DNA
ataactaaactgcata

SEQ ID NO: 553 - DNA, 19 bp, synthetic construct
  misc_feature 1..19: note = Oligonucleotide motif
  source 1..19: mol_type = other DNA
ttattaataactaaactgc

SEQ ID NO: 554 - DNA, 19 bp, synthetic construct
  misc_feature 1..19: note = Oligonucleotide motif
  source 1..19: mol_type = other DNA
tagtacattattaataact

SEQ ID NO: 555 - DNA, 16 bp, synthetic construct
  misc_feature 1..16: note = Oligonucleotide motif
  source 1..16: mol_type = other DNA
cataactaaggacgtt

SEQ ID NO: 556 - DNA, 16 bp, synthetic construct
  misc_feature 1..16: note = Oligonucleotide motif
  source 1..16: mol_type = other DNA
tcataactaaggacgt

SEQ ID NO: 557 - DNA, 16 bp, synthetic construct
  misc_feature 1..16: note = Oligonucleotide motif
  source 1..16: mol_type = other DNA
cgtcataactaaggac

SEQ ID NO: 558 - DNA, 16 bp, synthetic construct
  misc_feature 1..16: note = Oligonucleotide motif
  source 1..16: mol_type = other DNA
tcgtcataactaagga

SEQ ID NO: 559 - DNA, 16 bp, synthetic construct
  misc_feature 1..16: note = Oligonucleotide motif
  source 1..16: mol_type = other DNA
atcgtcataactaagg

SEQ ID NO: 560 - DNA, 16 bp, synthetic construct
  misc_feature 1..16: note = Oligonucleotide motif
  source 1..16: mol_type = other DNA
gttagtatcttacatt

SEQ ID NO: 561 - DNA, 16 bp, synthetic construct
  misc_feature 1..16: note = Oligonucleotide motif
  source 1..16: mol_type = other DNA
ctctattgttagtatc

SEQ ID NO: 562 - DNA, 16 bp, synthetic construct
  misc_feature 1..16: note = Oligonucleotide motif
  source 1..16: mol_type = other DNA
agtatagagttactgt

SEQ ID NO: 563 - DNA, 16 bp, synthetic construct
  misc_feature 1..16: note = Oligonucleotide motif
  source 1..16: mol_type = other DNA
ttcctggtgatacttt

SEQ ID NO: 564 - DNA, 16 bp, synthetic construct
  misc_feature 1..16: note = Oligonucleotide motif
  source 1..16: mol_type = other DNA
gttcctggtgatactt

SEQ ID NO: 565 - DNA, 16 bp, synthetic construct
  misc_feature 1..16: note = Oligonucleotide motif
  source 1..16: mol_type = other DNA
tgttcctggtgatact

SEQ ID NO: 566 - DNA, 18 bp, synthetic construct
  misc_feature 1..18: note = Oligonucleotide motif
  source 1..18: mol_type = other DNA
ataaacatgaatctctcc

SEQ ID NO: 567 - DNA, 19 bp, synthetic construct
  misc_feature 1..19: note = Oligonucleotide motif
  source 1..19: mol_type = other DNA
ctttataaacatgaatctc

SEQ ID NO: 568 - DNA, 17 bp, synthetic construct
  misc_feature 1..17: note = Oligonucleotide motif
  source 1..17: mol_type = other DNA
ctgtctttataaacatg

SEQ ID NO: 569 - DNA, 18 bp, synthetic construct
  misc_feature 1..18: note = Oligonucleotide motif
  source 1..18: mol_type = other DNA
ttgttataaatctgtctt

SEQ ID NO: 570 - DNA, 19 bp, synthetic construct
  misc_feature 1..19: note = Oligonucleotide motif
  source 1..19: mol_type = other DNA
ttaaatttattcttggata

SEQ ID NO: 571 - DNA, 18 bp, synthetic construct
  misc_feature 1..18: note = Oligonucleotide motif
  source 1..18: mol_type = other DNA
cttaaatttattcttgga

SEQ ID NO: 572 - DNA, 19 bp, synthetic construct
  misc_feature 1..19: note = Oligonucleotide motif
  source 1..19: mol_type = other DNA
cttcttaaatttattcttg

SEQ ID NO: 573 - DNA, 17 bp, synthetic construct
  misc_feature 1..17: note = Oligonucleotide motif
  source 1..17: mol_type = other DNA
tatgtttctcagtaaag

SEQ ID NO: 574 - DNA, 17 bp, synthetic construct
  misc_feature 1..17: note = Oligonucleotide motif
  source 1..17: mol_type = other DNA
gaattatctttaaacca

SEQ ID NO: 575 - DNA, 16 bp, synthetic construct
  misc_feature 1..16: note = Oligonucleotide motif
  source 1..16: mol_type = other DNA
cccttaaatttctaca

SEQ ID NO: 576 - DNA, 16 bp, synthetic construct
  misc_feature 1..16: note = Oligonucleotide motif
  source 1..16: mol_type = other DNA
acactgctcttgtacc

SEQ ID NO: 577 - DNA, 16 bp, synthetic construct
  misc_feature 1..16: note = Oligonucleotide motif
  source 1..16: mol_type = other DNA
tgacaacactgctctt

SEQ ID NO: 578 - DNA, 16 bp, synthetic construct
  misc_feature 1..16: note = Oligonucleotide motif
  source 1..16: mol_type = other DNA
tacatttattgggctc

SEQ ID NO: 579 - DNA, 16 bp, synthetic construct
  misc_feature 1..16: note = Oligonucleotide motif
  source 1..16: mol_type = other DNA
gtacatttattgggct

SEQ ID NO: 580 - DNA, 16 bp, synthetic construct
  misc_feature 1..16: note = Oligonucleotide motif
  source 1..16: mol_type = other DNA
ttggtacatttattgg

SEQ ID NO: 581 - DNA, 17 bp, synthetic construct
  misc_feature 1..17: note = Oligonucleotide motif
  source 1..17: mol_type = other DNA
catgttggtacatttat

SEQ ID NO: 582 - DNA, 16 bp, synthetic construct
  misc_feature 1..16: note = Oligonucleotide motif
  source 1..16: mol_type = other DNA
aatcatgttggtacat

SEQ ID NO: 583 - DNA, 16 bp, synthetic construct
  misc_feature 1..16: note = Oligonucleotide motif
  source 1..16: mol_type = other DNA
aaatcatgttggtaca

SEQ ID NO: 584 - DNA, 16 bp, synthetic construct
  misc_feature 1..16: note = Oligonucleotide motif
  source 1..16: mol_type = other DNA
gacaagtttggattaa

SEQ ID NO: 585 - DNA, 16 bp, synthetic construct
  misc_feature 1..16: note = Oligonucleotide motif
  source 1..16: mol_type = other DNA
aatgttcagatgcctc

SEQ ID NO: 586 - DNA, 16 bp, synthetic construct
  misc_feature 1..16: note = Oligonucleotide motif
  source 1..16: mol_type = other DNA
gcttaatgttcagatg

SEQ ID NO: 587 - DNA, 16 bp, synthetic construct
  misc_feature 1..16: note = Oligonucleotide motif
  source 1..16: mol_type = other DNA
cgtacatagcttgatg

SEQ ID NO: 588 - DNA, 16 bp, synthetic construct
  misc_feature 1..16: note = Oligonucleotide motif
  source 1..16: mol_type = other DNA
gtgaggaattaggata

SEQ ID NO: 589 - DNA, 16 bp, synthetic construct
  misc_feature 1..16: note = Oligonucleotide motif
  source 1..16: mol_type = other DNA
gtaacaatatggtttg

SEQ ID NO: 590 - DNA, 16 bp, synthetic construct
  misc_feature 1..16: note = Oligonucleotide motif
  source 1..16: mol_type = other DNA
gaaatattgtagacta

SEQ ID NO: 591 - DNA, 16 bp, synthetic construct
  misc_feature 1..16: note = Oligonucleotide motif
  source 1..16: mol_type = other DNA
ttgaaatattgtagac

SEQ ID NO: 592 - DNA, 16 bp, synthetic construct
  misc_feature 1..16: note = Oligonucleotide motif
  source 1..16: mol_type = other DNA
aagtctagtaatttgc

SEQ ID NO: 593 - DNA, 16 bp, synthetic construct
  misc_feature 1..16: note = Oligonucleotide motif
  source 1..16: mol_type = other DNA
gctcagtagattataa

SEQ ID NO: 594 - DNA, 16 bp, synthetic construct
  misc_feature 1..16: note = Oligonucleotide motif
  source 1..16: mol_type = other DNA
catacactgttgctaa

SEQ ID NO: 595 - DNA, 16 bp, synthetic construct
  misc_feature 1..16: note = Oligonucleotide motif
  source 1..16: mol_type = other DNA
atggtctcaaatcatt

SEQ ID NO: 596 - DNA, 16 bp, synthetic construct
  misc_feature 1..16: note = Oligonucleotide motif
  source 1..16: mol_type = other DNA
caatggtctcaaatca

SEQ ID NO: 597 - DNA, 16 bp, synthetic construct
  misc_feature 1..16: note = Oligonucleotide motif
  source 1..16: mol_type = other DNA
ttcctattgattgact

SEQ ID NO: 598 - DNA, 16 bp, synthetic construct
  misc_feature 1..16: note = Oligonucleotide motif
  source 1..16: mol_type = other DNA
tttctgttcacaacac

SEQ ID NO: 599 - DNA, 16 bp, synthetic construct
  misc_feature 1..16: note = Oligonucleotide motif
  source 1..16: mol_type = other DNA
aggaacccactaatct

SEQ ID NO: 600 - DNA, 16 bp, synthetic construct
  misc_feature 1..16: note = Oligonucleotide motif
  source 1..16: mol_type = other DNA
taaatggcaggaaccc

SEQ ID NO: 601 - DNA, 16 bp, synthetic construct
  misc_feature 1..16: note = Oligonucleotide motif
  source 1..16: mol_type = other DNA
gtaaatggcaggaacc

SEQ ID NO: 602 - DNA, 16 bp, synthetic construct
  misc_feature 1..16: note = Oligonucleotide motif
  source 1..16: mol_type = other DNA
ttgtaaatggcaggaa

SEQ ID NO: 603 - DNA, 16 bp, synthetic construct
  misc_feature 1..16: note = Oligonucleotide motif
  source 1..16: mol_type = other DNA
ttatgagttaggcatg

SEQ ID NO: 604 - DNA, 16 bp, synthetic construct
  misc_feature 1..16: note = Oligonucleotide motif
  source 1..16: mol_type = other DNA
ccaggtgaaactttaa

SEQ ID NO: 605 - DNA, 16 bp, synthetic construct
  misc_feature 1..16: note = Oligonucleotide motif
  source 1..16: mol_type = other DNA
cccttagtcagctcct

SEQ ID NO: 606 - DNA, 16 bp, synthetic construct
  misc_feature 1..16: note = Oligonucleotide motif
  source 1..16: mol_type = other DNA
acccttagtcagctcc

SEQ ID NO: 607 - DNA, 16 bp, synthetic construct
  misc_feature 1..16: note = Oligonucleotide motif
  source 1..16: mol_type = other DNA
cacccttagtcagctc

SEQ ID NO: 608 - DNA, 16 bp, synthetic construct
  misc_feature 1..16: note = Oligonucleotide motif
  source 1..16: mol_type = other DNA
tctcttactaggctcc

SEQ ID NO: 609 - DNA, 16 bp, synthetic construct
  misc_feature 1..16: note = Oligonucleotide motif
  source 1..16: mol_type = other DNA
cctatctgtcatcatg

SEQ ID NO: 610 - DNA, 16 bp, synthetic construct
  misc_feature 1..16: note = Oligonucleotide motif
  source 1..16: mol_type = other DNA
tcctatctgtcatcat

SEQ ID NO: 611 - DNA, 16 bp, synthetic construct
  misc_feature 1..16: note = Oligonucleotide motif
  source 1..16: mol_type = other DNA
gagaagtgtgagaagc

SEQ ID NO: 612 - DNA, 16 bp, synthetic construct
  misc_feature 1..16: note = Oligonucleotide motif
  source 1..16: mol_type = other DNA
catccttgaagtttag

SEQ ID NO: 613 - DNA, 16 bp, synthetic construct
  misc_feature 1..16: note = Oligonucleotide motif
  source 1..16: mol_type = other DNA
taataagatggctccc

SEQ ID NO: 614 - DNA, 16 bp, synthetic construct
  misc_feature 1..16: note = Oligonucleotide motif
  source 1..16: mol_type = other DNA
caaggcataataagat

SEQ ID NO: 615 - DNA, 16 bp, synthetic construct
  misc_feature 1..16: note = Oligonucleotide motif
  source 1..16: mol_type = other DNA
ccaaggcataataaga

SEQ ID NO: 616 - DNA, 16 bp, synthetic construct
  misc_feature 1..16: note = Oligonucleotide motif
  source 1..16: mol_type = other DNA
tgatccaattctcacc

SEQ ID NO: 617 - DNA, 16 bp, synthetic construct
  misc_feature 1..16: note = Oligonucleotide motif
  source 1..16: mol_type = other DNA
atgatccaattctcac

SEQ ID NO: 618 - DNA, 16 bp, synthetic construct
  misc_feature 1..16: note = Oligonucleotide motif
  source 1..16: mol_type = other DNA
cgcttcatcttcaccc

SEQ ID NO: 619 - DNA, 16 bp, synthetic construct
  misc_feature 1..16: note = Oligonucleotide motif
  source 1..16: mol_type = other DNA
tatgacactgcatctt

SEQ ID NO: 620 - DNA, 16 bp, synthetic construct
  misc_feature 1..16: note = Oligonucleotide motif
  source 1..16: mol_type = other DNA
gtatgacactgcatct

SEQ ID NO: 621 - DNA, 16 bp, synthetic construct
  misc_feature 1..16: note = Oligonucleotide motif
  source 1..16: mol_type = other DNA
tgtatgacactgcatc

SEQ ID NO: 622 - DNA, 16 bp, synthetic construct
  misc_feature 1..16: note = Oligonucleotide motif
  source 1..16: mol_type = other DNA
ttctcttctgtaagtc

SEQ ID NO: 623 - DNA, 16 bp, synthetic construct
  misc_feature 1..16: note = Oligonucleotide motif
  source 1..16: mol_type = other DNA
ttctacagaggaacta

SEQ ID NO: 624 - DNA, 16 bp, synthetic construct
  misc_feature 1..16: note = Oligonucleotide motif
  source 1..16: mol_type = other DNA
actacagttctacaga

SEQ ID NO: 625 - DNA, 16 bp, synthetic construct
  misc_feature 1..16: note = Oligonucleotide motif
  source 1..16: mol_type = other DNA
ttcccacaggtaaatg

SEQ ID NO: 626 - DNA, 20 bp, synthetic construct
  misc_feature 1..20: note = Oligonucleotide motif
  source 1..20: mol_type = other DNA
attatttgaatatactcatt

SEQ ID NO: 627 - DNA, 17 bp, synthetic construct
  misc_feature 1..17: note = Oligonucleotide motif
  source 1..17: mol_type = other DNA
tgggaggaaattatttg

SEQ ID NO: 628 - DNA, 16 bp, synthetic construct
  misc_feature 1..16: note = Oligonucleotide motif
  source 1..16: mol_type = other DNA
tgactcatcttaaatg

SEQ ID NO: 629 - DNA, 16 bp, synthetic construct
  misc_feature 1..16: note = Oligonucleotide motif
  source 1..16: mol_type = other DNA
ctgactcatcttaaat

SEQ ID NO: 630 - DNA, 16 bp, synthetic construct
  misc_feature 1..16: note = Oligonucleotide motif
  source 1..16: mol_type = other DNA
tttactctgactcatc

SEQ ID NO: 631 - DNA, 16 bp, synthetic construct
  misc_feature 1..16: note = Oligonucleotide motif
  source 1..16: mol_type = other DNA
tattggaggaattatt

SEQ ID NO: 632 - DNA, 16 bp, synthetic construct
  misc_feature 1..16: note = Oligonucleotide motif
  source 1..16: mol_type = other DNA
gtattggaggaattat

SEQ ID NO: 633 - DNA, 20 bp, synthetic construct
  misc_feature 1..20: note = Oligonucleotide motif
  source 1..20: mol_type = other DNA
tggtatacttctctaagtat

SEQ ID NO: 634 - DNA, 16 bp, synthetic construct
  misc_feature 1..16: note = Oligonucleotide motif
  source 1..16: mol_type = other DNA
gatctcttggtatact

SEQ ID NO: 635 - DNA, 16 bp, synthetic construct
  misc_feature 1..16: note = Oligonucleotide motif
  source 1..16: mol_type = other DNA
cagacaactctatacc

SEQ ID NO: 636 - DNA, 17 bp, synthetic construct
  misc_feature 1..17: note = Oligonucleotide motif
  source 1..17: mol_type = other DNA
aacatcagacaactcta

SEQ ID NO: 637 - DNA, 18 bp, synthetic construct
  misc_feature 1..18: note = Oligonucleotide motif
  source 1..18: mol_type = other DNA
tttaacatcagacaactc

SEQ ID NO: 638 - DNA, 16 bp, synthetic construct
  misc_feature 1..16: note = Oligonucleotide motif
  source 1..16: mol_type = other DNA
taacatcagacaactc

SEQ ID NO: 639 - DNA, 16 bp, synthetic construct
  misc_feature 1..16: note = Oligonucleotide motif
  source 1..16: mol_type = other DNA
atttaacatcagacaa

SEQ ID NO: 640 - DNA, 17 bp, synthetic construct
  misc_feature 1..17: note = Oligonucleotide motif
  source 1..17: mol_type = other DNA
cctatttaacatcagac

SEQ ID NO: 641 - DNA, 16 bp, synthetic construct
  misc_feature 1..16: note = Oligonucleotide motif
  source 1..16: mol_type = other DNA
tccctatttaacatca

SEQ ID NO: 642 - DNA, 17 bp, synthetic construct
  misc_feature 1..17: note = Oligonucleotide motif
  source 1..17: mol_type = other DNA
tcaacgactattggaat

SEQ ID NO: 643 - DNA, 16 bp, synthetic construct
  misc_feature 1..16: note = Oligonucleotide motif
  source 1..16: mol_type = other DNA
cttatattctggctat

SEQ ID NO: 644 - DNA, 16 bp, synthetic construct
  misc_feature 1..16: note = Oligonucleotide motif
  source 1..16: mol_type = other DNA
atccttatattctggc

SEQ ID NO: 645 - DNA, 16 bp, synthetic construct
  misc_feature 1..16: note = Oligonucleotide motif
  source 1..16: mol_type = other DNA
gatccttatattctgg

SEQ ID NO: 646 - DNA, 16 bp, synthetic construct
  misc_feature 1..16: note = Oligonucleotide motif
  source 1..16: mol_type = other DNA
tgatccttatattctg

SEQ ID NO: 647 - DNA, 16 bp, synthetic construct
  misc_feature 1..16: note = Oligonucleotide motif
  source 1..16: mol_type = other DNA
attgaaacttgatcct

SEQ ID NO: 648 - DNA, 16 bp, synthetic construct
  misc_feature 1..16: note = Oligonucleotide motif
  source 1..16: mol_type = other DNA
actgtcattgaaactt

SEQ ID NO: 649 - DNA, 16 bp, synthetic construct
  misc_feature 1..16: note = Oligonucleotide motif
  source 1..16: mol_type = other DNA
tcttactgtcattgaa

SEQ ID NO: 650 - DNA, 17 bp, synthetic construct
  misc_feature 1..17: note = Oligonucleotide motif
  source 1..17: mol_type = other DNA
aggatcttactgtcatt

SEQ ID NO: 651 - DNA, 16 bp, synthetic construct
  misc_feature 1..16: note = Oligonucleotide motif
  source 1..16: mol_type = other DNA
gcaaatcaactccatc

SEQ ID NO: 652 - DNA, 16 bp, synthetic construct
  misc_feature 1..16: note = Oligonucleotide motif
  source 1..16: mol_type = other DNA
gtgcaaatcaactcca

SEQ ID NO: 653 - DNA, 17 bp, synthetic construct
  misc_feature 1..17: note = Oligonucleotide motif
  source 1..17: mol_type = other DNA
caattatttctttgtgc

SEQ ID NO: 654 - DNA, 18 bp, synthetic construct
  misc_feature 1..18: note = Oligonucleotide motif
  source 1..18: mol_type = other DNA
tggcaacaattatttctt

SEQ ID NO: 655 - DNA, 16 bp, synthetic construct
  misc_feature 1..16: note = Oligonucleotide motif
  source 1..16: mol_type = other DNA
gctggcaacaattatt

SEQ ID NO: 656 - DNA, 16 bp, synthetic construct
  misc_feature 1..16: note = Oligonucleotide motif
  source 1..16: mol_type = other DNA
atccatttctactgcc

SEQ ID NO: 657 - DNA, 19 bp, synthetic construct
  misc_feature 1..19: note = Oligonucleotide motif
  source 1..19: mol_type = other DNA
taatatctattgatttcta

SEQ ID NO: 658 - DNA, 16 bp, synthetic construct
  misc_feature 1..16: note = Oligonucleotide motif
  source 1..16: mol_type = other DNA
tcaatagtgtagggca

SEQ ID NO: 659 - DNA, 16 bp, synthetic construct
  misc_feature 1..16: note = Oligonucleotide motif
  source 1..16: mol_type = other DNA
ttcaatagtgtagggc

SEQ ID NO: 660 - DNA, 19 bp, synthetic construct
  misc_feature 1..19: note = Oligonucleotide motif
  source 1..19: mol_type = other DNA
aggttaattaattcaatag

SEQ ID NO: 661 - DNA, 16 bp, synthetic construct
  misc_feature 1..16: note = Oligonucleotide motif
  source 1..16: mol_type = other DNA
catttgtaatccctag

SEQ ID NO: 662 - DNA, 16 bp, synthetic construct
  misc_feature 1..16: note = Oligonucleotide motif
  source 1..16: mol_type = other DNA
acatttgtaatcccta

SEQ ID NO: 663 - DNA, 16 bp, synthetic construct
  misc_feature 1..16: note = Oligonucleotide motif
  source 1..16: mol_type = other DNA
aacatttgtaatccct

SEQ ID NO: 664 - DNA, 16 bp, synthetic construct
  misc_feature 1..16: note = Oligonucleotide motif
  source 1..16: mol_type = other DNA
taaatttcaagttctg

SEQ ID NO: 665 - DNA, 18 bp, synthetic construct
  misc_feature 1..18: note = Oligonucleotide motif
  source 1..18: mol_type = other DNA
gtttaaatttcaagttct

SEQ ID NO: 666 - DNA, 18 bp, synthetic construct
  misc_feature 1..18: note = Oligonucleotide motif
  source 1..18: mol_type = other DNA
ccaagtttaaatttcaag

SEQ ID NO: 667 - DNA, 17 bp, synthetic construct
  misc_feature 1..17: note = Oligonucleotide motif
  source 1..17: mol_type = other DNA
acccaagtttaaatttc

SEQ ID NO: 668 - DNA, 19 bp, synthetic construct
  misc_feature 1..19: note = Oligonucleotide motif
  source 1..19: mol_type = other DNA
catacagtgacccaagttt

SEQ ID NO: 669 - DNA, 16 bp, synthetic construct
  misc_feature 1..16: note = Oligonucleotide motif
  source 1..16: mol_type = other DNA
acatcccatacagtga

SEQ ID NO: 670 - DNA, 16 bp, synthetic construct
  misc_feature 1..16: note = Oligonucleotide motif
  source 1..16: mol_type = other DNA
agcacagctctacatc

SEQ ID NO: 671 - DNA, 16 bp, synthetic construct
  misc_feature 1..16: note = Oligonucleotide motif
  source 1..16: mol_type = other DNA
atatagcacagctcta

SEQ ID NO: 672 - DNA, 16 bp, synthetic construct
  misc_feature 1..16: note = Oligonucleotide motif
  source 1..16: mol_type = other DNA
tccatatagcacagct

SEQ ID NO: 673 - DNA, 16 bp, synthetic construct
  misc_feature 1..16: note = Oligonucleotide motif
  source 1..16: mol_type = other DNA
atttccatatagcaca

SEQ ID NO: 674 - DNA, 17 bp, synthetic construct
  misc_feature 1..17: note = Oligonucleotide motif
  source 1..17: mol_type = other DNA
tttatttccatatagca

SEQ ID NO: 675 - DNA, 16 bp, synthetic construct
  misc_feature 1..16: note = Oligonucleotide motif
  source 1..16: mol_type = other DNA
tttatttccatatagc

SEQ ID NO: 676 - DNA, 17 bp, synthetic construct
  misc_feature 1..17: note = Oligonucleotide motif
  source 1..17: mol_type = other DNA
aaggagaggagattatg

SEQ ID NO: 677 - DNA, 16 bp, synthetic construct
  misc_feature 1..16: note = Oligonucleotide motif
  source 1..16: mol_type = other DNA
agttcttgtgttagct

SEQ ID NO: 678 - DNA, 16 bp, synthetic construct
  misc_feature 1..16: note = Oligonucleotide motif
  source 1..16: mol_type = other DNA
gagttcttgtgttagc

SEQ ID NO: 679 - DNA, 17 bp, synthetic construct
  misc_feature 1..17: note = Oligonucleotide motif
  source 1..17: mol_type = other DNA
attaattatccatccac

SEQ ID NO: 680 - DNA, 18 bp, synthetic construct
  misc_feature 1..18: note = Oligonucleotide motif
  source 1..18: mol_type = other DNA
atcaattaattatccatc

SEQ ID NO: 681 - DNA, 18 bp, synthetic construct
  misc_feature 1..18: note = Oligonucleotide motif
  source 1..18: mol_type = other DNA
agaatcaattaattatcc

SEQ ID NO: 682 - DNA, 16 bp, synthetic construct
  misc_feature 1..16: note = Oligonucleotide motif
  source 1..16: mol_type = other DNA
tgagataccgtgcatg

SEQ ID NO: 683 - DNA, 16 bp, synthetic construct
  misc_feature 1..16: note = Oligonucleotide motif
  source 1..16: mol_type = other DNA
aatgagataccgtgca

SEQ ID NO: 684 - DNA, 16 bp, synthetic construct
  misc_feature 1..16: note = Oligonucleotide motif
  source 1..16: mol_type = other DNA
ctgtggttaggctaat

SEQ ID NO: 685 - DNA, 20 bp, synthetic construct
  misc_feature 1..20: note = Oligonucleotide motif
  source 1..20: mol_type = other DNA
aagagtaagggtctgtggtt

SEQ ID NO: 686 - DNA, 16 bp, synthetic construct
  misc_feature 1..16: note = Oligonucleotide motif
  source 1..16: mol_type = other DNA
gatgggttaagagtaa

SEQ ID NO: 687 - DNA, 16 bp, synthetic construct
  misc_feature 1..16: note = Oligonucleotide motif
  source 1..16: mol_type = other DNA
agcagatgggttaaga

SEQ ID NO: 688 - DNA, 16 bp, synthetic construct
  misc_feature 1..16: note = Oligonucleotide motif
  source 1..16: mol_type = other DNA
tgtaaacatttgtagc

SEQ ID NO: 689 - DNA, 16 bp, synthetic construct
  misc_feature 1..16: note = Oligonucleotide motif
  source 1..16: mol_type = other DNA
cctgcttataaatgta

SEQ ID NO: 690 - DNA, 16 bp, synthetic construct
  misc_feature 1..16: note = Oligonucleotide motif
  source 1..16: mol_type = other DNA
tgccctgcttataaat

SEQ ID NO: 691 - DNA, 16 bp, synthetic construct
  misc_feature 1..16: note = Oligonucleotide motif
  source 1..16: mol_type = other DNA
tcttcttagttcaata

SEQ ID NO: 692 - DNA, 16 bp, synthetic construct
  misc_feature 1..16: note = Oligonucleotide motif
  source 1..16: mol_type = other DNA
tggtttctaactacat

SEQ ID NO: 693 - DNA, 17 bp, synthetic construct
  misc_feature 1..17: note = Oligonucleotide motif
  source 1..17: mol_type = other DNA
agtttggtttctaacta

SEQ ID NO: 694 - DNA, 16 bp, synthetic construct
  misc_feature 1..16: note = Oligonucleotide motif
  source 1..16: mol_type = other DNA
gaatgaaacttgcctg

SEQ ID NO: 695 - DNA, 16 bp, synthetic construct
  misc_feature 1..16: note = Oligonucleotide motif
  source 1..16: mol_type = other DNA
attatccttacatgat

SEQ ID NO: 696 - DNA, 16 bp, synthetic construct
  misc_feature 1..16: note = Oligonucleotide motif
  source 1..16: mol_type = other DNA
gtacccaattatcctt

SEQ ID NO: 697 - DNA, 16 bp, synthetic construct
  misc_feature 1..16: note = Oligonucleotide motif
  source 1..16: mol_type = other DNA
tgtacccaattatcct

SEQ ID NO: 698 - DNA, 16 bp, synthetic construct
  misc_feature 1..16: note = Oligonucleotide motif
  source 1..16: mol_type = other DNA
ttgtacccaattatcc

SEQ ID NO: 699 - DNA, 16 bp, synthetic construct
  misc_feature 1..16: note = Oligonucleotide motif
  source 1..16: mol_type = other DNA
tttgtacccaattatc

SEQ ID NO: 700 - DNA, 16 bp, synthetic construct
  misc_feature 1..16: note = Oligonucleotide motif
  source 1..16: mol_type = other DNA
agcagcaggttatatt

SEQ ID NO: 701 - DNA, 16 bp, synthetic construct
  misc_feature 1..16: note = Oligonucleotide motif
  source 1..16: mol_type = other DNA
tgggaagtggtctggg

SEQ ID NO: 702 - DNA, 16 bp, synthetic construct
  misc_feature 1..16: note = Oligonucleotide motif
  source 1..16: mol_type = other DNA
ctggagagtgataata

SEQ ID NO: 703 - DNA, 16 bp, synthetic construct
  misc_feature 1..16: note = Oligonucleotide motif
  source 1..16: mol_type = other DNA
aatgctggattacgtc

SEQ ID NO: 704 - DNA, 16 bp, synthetic construct
  misc_feature 1..16: note = Oligonucleotide motif
  source 1..16: mol_type = other DNA
caatgctggattacgt

SEQ ID NO: 705 - DNA, 16 bp, synthetic construct
  misc_feature 1..16: note = Oligonucleotide motif
  source 1..16: mol_type = other DNA
ttgttcagaagtatcc

SEQ ID NO: 706 - DNA, 16 bp, synthetic construct
  misc_feature 1..16: note = Oligonucleotide motif
  source 1..16: mol_type = other DNA
gatgatttgcttggag

SEQ ID NO: 707 - DNA, 16 bp, synthetic construct
  misc_feature 1..16: note = Oligonucleotide motif
  source 1..16: mol_type = other DNA
gaaatcattcacaacc

SEQ ID NO: 708 - DNA, 16 bp, synthetic construct
  misc_feature 1..16: note = Oligonucleotide motif
  source 1..16: mol_type = other DNA
ttgtaacatctactac

SEQ ID NO: 709 - DNA, 16 bp, synthetic construct
  misc_feature 1..16: note = Oligonucleotide motif
  source 1..16: mol_type = other DNA
cattaagcagcaagtt

SEQ ID NO: 710 - DNA, 16 bp, synthetic construct
  misc_feature 1..16: note = Oligonucleotide motif
  source 1..16: mol_type = other DNA
ttactagatgtgagca

SEQ ID NO: 711 - DNA, 16 bp, synthetic construct
  misc_feature 1..16: note = Oligonucleotide motif
  source 1..16: mol_type = other DNA
tttactagatgtgagc

SEQ ID NO: 712 - DNA, 16 bp, synthetic construct
  misc_feature 1..16: note = Oligonucleotide motif
  source 1..16: mol_type = other DNA
gaccaagcaccttaca

SEQ ID NO: 713 - DNA, 16 bp, synthetic construct
  misc_feature 1..16: note = Oligonucleotide motif
  source 1..16: mol_type = other DNA
agaccaagcaccttac

SEQ ID NO: 714 - DNA, 16 bp, synthetic construct
  misc_feature 1..16: note = Oligonucleotide motif
  source 1..16: mol_type = other DNA
atgggttaaataaagg

SEQ ID NO: 715 - DNA, 16 bp, synthetic construct
  misc_feature 1..16: note = Oligonucleotide motif
  source 1..16: mol_type = other DNA
tcaaccagagtattaa

SEQ ID NO: 716 - DNA, 16 bp, synthetic construct
  misc_feature 1..16: note = Oligonucleotide motif
  source 1..16: mol_type = other DNA
gtcaaccagagtatta

SEQ ID NO: 717 - DNA, 16 bp, synthetic construct
  misc_feature 1..16: note = Oligonucleotide motif
  source 1..16: mol_type = other DNA
attgtaaagctgatat

SEQ ID NO: 718 - DNA, 16 bp, synthetic construct
  misc_feature 1..16: note = Oligonucleotide motif
  source 1..16: mol_type = other DNA
cacataattgtaaagc

SEQ ID NO: 719 - DNA, 16 bp, synthetic construct
  misc_feature 1..16: note = Oligonucleotide motif
  source 1..16: mol_type = other DNA
gaggtctgctatttac

SEQ ID NO: 720 - DNA, 16 bp, synthetic construct
  misc_feature 1..16: note = Oligonucleotide motif
  source 1..16: mol_type = other DNA
tgtagattcaatgcct

SEQ ID NO: 721 - DNA, 16 bp, synthetic construct
  misc_feature 1..16: note = Oligonucleotide motif
  source 1..16: mol_type = other DNA
cctcattatactatga

SEQ ID NO: 722 - DNA, 16 bp, synthetic construct
  misc_feature 1..16: note = Oligonucleotide motif
  source 1..16: mol_type = other DNA
ccttatgctatgacac

SEQ ID NO: 723 - DNA, 16 bp, synthetic construct
  misc_feature 1..16: note = Oligonucleotide motif
  source 1..16: mol_type = other DNA
tccttatgctatgaca

SEQ ID NO: 724 - DNA, 16 bp, synthetic construct
  misc_feature 1..16: note = Oligonucleotide motif
  source 1..16: mol_type = other DNA
aagatgtttaagtata

SEQ ID NO: 725 - DNA, 16 bp, synthetic construct
  misc_feature 1..16: note = Oligonucleotide motif
  source 1..16: mol_type = other DNA
ctgattattaagatgt

SEQ ID NO: 726 - DNA, 16 bp, synthetic construct
  misc_feature 1..16: note = Oligonucleotide motif
  source 1..16: mol_type = other DNA
tggaaaggtatgaatt

SEQ ID NO: 727 - DNA, 16 bp, synthetic construct
  misc_feature 1..16: note = Oligonucleotide motif
  source 1..16: mol_type = other DNA
acttgaatggcttgga

SEQ ID NO: 728 - DNA, 16 bp, synthetic construct
  misc_feature 1..16: note = Oligonucleotide motif
  source 1..16: mol_type = other DNA
aacttgaatggcttgg

SEQ ID NO: 729 - DNA, 16 bp, synthetic construct
  misc_feature 1..16: note = Oligonucleotide motif
  source 1..16: mol_type = other DNA
caatgtgttactattt

SEQ ID NO: 730 - DNA, 16 bp, synthetic construct
  misc_feature 1..16: note = Oligonucleotide motif
  source 1..16: mol_type = other DNA
acaatgtgttactatt

SEQ ID NO: 731 - DNA, 16 bp, synthetic construct
  misc_feature 1..16: note = Oligonucleotide motif
  source 1..16: mol_type = other DNA
catctgctatataaga

SEQ ID NO: 732 - DNA, 16 bp, synthetic construct
  misc_feature 1..16: note = Oligonucleotide motif
  source 1..16: mol_type = other DNA
cctagagcaaatactt

SEQ ID NO: 733 - DNA, 16 bp, synthetic construct
  misc_feature 1..16: note = Oligonucleotide motif
  source 1..16: mol_type = other DNA
cagagttaataataag

SEQ ID NO: 734 - DNA, 16 bp, synthetic construct
  misc_feature 1..16: note = Oligonucleotide motif
  source 1..16: mol_type = other DNA
gttcaagcacaacgaa

SEQ ID NO: 735 - DNA, 16 bp, synthetic construct
  misc_feature 1..16: note = Oligonucleotide motif
  source 1..16: mol_type = other DNA
agggttcaagcacaac

SEQ ID NO: 736 - DNA, 16 bp, synthetic construct
  misc_feature 1..16: note = Oligonucleotide motif
  source 1..16: mol_type = other DNA
tgttggagacactgtt

SEQ ID NO: 737 - DNA, 16 bp, synthetic construct
  misc_feature 1..16: note = Oligonucleotide motif
  source 1..16: mol_type = other DNA
aaggaggagttaggac

SEQ ID NO: 738 - DNA, 16 bp, synthetic construct
  misc_feature 1..16: note = Oligonucleotide motif
  source 1..16: mol_type = other DNA
ctatgccatttacgat

SEQ ID NO: 739 - DNA, 16 bp, synthetic construct
  misc_feature 1..16: note = Oligonucleotide motif
  source 1..16: mol_type = other DNA
tcaaatgcagaattag

SEQ ID NO: 740 - DNA, 16 bp, synthetic construct
  misc_feature 1..16: note = Oligonucleotide motif
  source 1..16: mol_type = other DNA
agtgacaatcaaatgc

SEQ ID NO: 741 - DNA, 16 bp, synthetic construct
  misc_feature 1..16: note = Oligonucleotide motif
  source 1..16: mol_type = other DNA
aagtgacaatcaaatg

SEQ ID NO: 742 - DNA, 16 bp, synthetic construct
  misc_feature 1..16: note = Oligonucleotide motif
  source 1..16: mol_type = other DNA
gtgtaccaagtaacaa

SEQ ID NO: 743 - DNA, 16 bp, synthetic construct
  misc_feature 1..16: note = Oligonucleotide motif
  source 1..16: mol_type = other DNA
tgggatgttaaactga

SEQ ID NO: 744 - DNA, 16 bp, synthetic construct
  misc_feature 1..16: note = Oligonucleotide motif
  source 1..16: mol_type = other DNA
agtttacattttctgc

SEQ ID NO: 745 - DNA, 16 bp, synthetic construct
  misc_feature 1..16: note = Oligonucleotide motif
  source 1..16: mol_type = other DNA
tatgtgaagaggagag

SEQ ID NO: 746 - DNA, 16 bp, synthetic construct
  misc_feature 1..16: note = Oligonucleotide motif
  source 1..16: mol_type = other DNA
cacctttaaaacccca

SEQ ID NO: 747 - DNA, 16 bp, synthetic construct
  misc_feature 1..16: note = Oligonucleotide motif
  source 1..16: mol_type = other DNA
tcctttataatcacac

SEQ ID NO: 748 - DNA, 16 bp, synthetic construct
  misc_feature 1..16: note = Oligonucleotide motif
  source 1..16: mol_type = other DNA
acggtattttcacagg

SEQ ID NO: 749 - DNA, 16 bp, synthetic construct
  misc_feature 1..16: note = Oligonucleotide motif
  source 1..16: mol_type = other DNA
gacactacaatgagga

SEQ ID NO: 750 - DNA, 16 bp, synthetic construct
  misc_feature 1..16: note = Oligonucleotide motif
  source 1..16: mol_type = other DNA
tggtttttaggactgt

SEQ ID NO: 751 - DNA, 16 bp, synthetic construct
  misc_feature 1..16: note = Oligonucleotide motif
  source 1..16: mol_type = other DNA
cgacaaattctatcct

SEQ ID NO: 752 - DNA, 16 bp, synthetic construct
  misc_feature 1..16: note = Oligonucleotide motif
  source 1..16: mol_type = other DNA
tgatatacaatgctac

SEQ ID NO: 753 - DNA, 16 bp, synthetic construct
  misc_feature 1..16: note = Oligonucleotide motif
  source 1..16: mol_type = other DNA
tcgttgggtaaattta

SEQ ID NO: 754 - DNA, 16 bp, synthetic construct
  misc_feature 1..16: note = Oligonucleotide motif
  source 1..16: mol_type = other DNA
tgctttataaatggtg

SEQ ID NO: 755 - DNA, 18 bp, synthetic construct
  misc_feature 1..18: note = Oligonucleotide motif
  source 1..18: mol_type = other DNA
caagtttacattttctgc

SEQ ID NO: 756 - DNA, 18 bp, synthetic construct
  misc_feature 1..18: note = Oligonucleotide motif
  source 1..18: mol_type = other DNA
catatgtgaagaggagag

SEQ ID NO: 757 - DNA, 16 bp, synthetic construct
  misc_feature 1..16: note = Oligonucleotide motif
  source 1..16: mol_type = other DNA
cacctttaaaacccca

SEQ ID NO: 758 - DNA, 18 bp, synthetic construct
  misc_feature 1..18: note = Oligonucleotide motif
  source 1..18: mol_type = other DNA
catcctttataatcacac

SEQ ID NO: 759 - DNA, 18 bp, synthetic construct
  misc_feature 1..18: note = Oligonucleotide motif
  source 1..18: mol_type = other DNA
caacggtattttcacagg

SEQ ID NO: 760 - DNA, 18 bp, synthetic construct
  misc_feature 1..18: note = Oligonucleotide motif
  source 1..18: mol_type = other DNA
cagacactacaatgagga

SEQ ID NO: 761 - DNA, 18 bp, synthetic construct
  misc_feature 1..18: note = Oligonucleotide motif
  source 1..18: mol_type = other DNA
catggtttttaggactgt

SEQ ID NO: 762 - DNA, 18 bp, synthetic construct
  misc_feature 1..18: note = Oligonucleotide motif
  source 1..18: mol_type = other DNA
cacgacaaattctatcct

SEQ ID NO: 763 - DNA, 18 bp, synthetic construct
  misc_feature 1..18: note = Oligonucleotide motif
  source 1..18: mol_type = other DNA
catgatatacaatgctac

SEQ ID NO: 764 - DNA, 18 bp, synthetic construct
  misc_feature 1..18: note = Oligonucleotide motif
  source 1..18: mol_type = other DNA
catcgttgggtaaattta

SEQ ID NO: 765 - DNA, 18 bp, synthetic construct
  misc_feature 1..18: note = Oligonucleotide motif
  source 1..18: mol_type = other DNA
catgctttataaatggtg

SEQ ID NO: 766 - DNA, 20 bp, synthetic construct
  misc_feature 1..20: note = Oligonucleotide motif
  source 1..20: mol_type = other DNA
caacaaataatggttactct

SEQ ID NO: 767 - DNA, 18 bp, synthetic construct
  misc_feature 1..18: note = Oligonucleotide motif
  source 1..18: mol_type = other DNA
cacagattgatggtagtt

SEQ ID NO: 768 - DNA, 19 bp, synthetic construct
  misc_feature 1..19: note = Oligonucleotide motif
  source 1..19: mol_type = other DNA
cacctatttaacatcagac

SEQ ID NO: 769 - DNA, 20 bp, synthetic construct
  misc_feature 1..20: note = Oligonucleotide motif
  source 1..20: mol_type = other DNA
cactaattgtagtagtactc

SEQ ID NO: 770 - DNA, 20 bp, synthetic construct
  misc_feature 1..20: note = Oligonucleotide motif
  source 1..20: mol_type = other DNA
caataaacatgaatctctcc

SEQ ID NO: 771 - DNA, 17 bp, synthetic construct
  misc_feature 1..17: note = Oligonucleotide motif
  source 1..17: mol_type = other DNA
tgatttaattctagtca

SEQ ID NO: 772 - DNA, 16 bp, synthetic construct
  misc_feature 1..16: note = Target sequence
  source 1..16: mol_type = other DNA
gcagtagagccaatta

SEQ ID NO: 773 - protein, 10 aa, synthetic construct
  REGION 1..10: note = HBV epitope
FLPSDFFPSV

SEQ ID NO: 774 - protein, 15 aa, synthetic construct
  REGION 1..15: note = HBV epitope
GRETVLEYLVSFGVW

SEQ ID NO: 775 - protein, 15 aa, synthetic construct
  REGION 1..15: note = HBV epitope
TTFHQTLQDPRVRGL

SEQ ID NO: 776 - protein, 16 aa, synthetic construct
  REGION 1..16: note = HBV epitope
QAGFFLLTRILTIPQS

SEQ ID NO: 777 - protein, 9 aa, synthetic construct
  REGION 1..9: note = HBV epitope
FLLTRILTI

SEQ ID NO: 778 - protein, 15 aa, synthetic construct
  REGION 1..15: note = HBV epitope
TSLNFLGGTTVCLGQ

SEQ ID NO: 779 - protein, 9 aa, synthetic construct
  REGION 1..9: note = HBV epitope
FLGGTTVCL

SEQ ID NO: 780 - protein, 9 aa, synthetic construct
  REGION 1..9: note = HBV epitope
WLSLLVPFV

SEQ ID NO: 781 - protein, 21 aa, synthetic construct
  REGION 1..21: note = HBV epitope
SLLVPFVQWFVGLSPTVWLSV

SEQ ID NO: 782 - protein, 10 aa, synthetic construct
  REGION 1..10: note = HBV epitope
GLSPTVWLSV

SEQ ID NO: 783 - protein, 10 aa, synthetic construct
  REGION 1..10: note = HBV epitope
SILSPFLPLL

SEQ ID NO: 784 - DNA, 24 bp, synthetic construct
  misc_feature 1..24: note = Primer
  source 1..24: mol_type = other DNA
aaggaaagaagtcagaaggcaaaa

SEQ ID NO: 785 - DNA, 19 bp, synthetic construct
  misc_feature 1..19: note = Primer
  source 1..19: mol_type = other DNA
ctgtgccttgggtggcttt

SEQ ID NO: 786 - DNA, 25 bp, synthetic construct
  misc_feature 1..25: note = primer
  source 1..25: mol_type = other DNA
ttctttataagggtcgatgtccatg

SEQ ID NO: 787 - DNA, 16 bp, synthetic construct
  misc_feature 1..16: note = Description of sequence: CMP ID NO: 5_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
taattggctctactgc

SEQ ID NO: 788 - DNA, 16 bp, synthetic construct
  misc_feature 1..16: note = Description of sequence: CMP ID NO: 6_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcgcataagaatgact

SEQ ID NO: 789 - DNA, 16 bp, synthetic construct
  misc_feature 1..16: note = Description of sequence: CMP ID NO: 7_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgaacacacagtcgca

SEQ ID NO: 790 - DNA, 16 bp, synthetic construct
  misc_feature 1..16: note = Description of sequence: CMP ID NO: 8_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctgaacacacagtcgc

SEQ ID NO: 791 - DNA, 16 bp, synthetic construct
  misc_feature 1..16: note = Description of sequence: CMP ID NO: 9_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tctgaacacacagtcg

SEQ ID NO: 792 - DNA, 16 bp, synthetic construct
  misc_feature 1..16: note = Description of sequence: CMP ID NO: 10_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA thymine nucleoside
  modified_base 3: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttctgaacacacagtc

SEQ ID NO: 793 - DNA, 16 bp, synthetic construct
  misc_feature 1..16: note = Description of sequence: CMP ID NO: 11_1
  source 1..16: mol_type = other DNA
  misc_feature 1..2: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acaagtcatgttacta

SEQ ID NO: 794 - DNA, 16 bp, synthetic construct
  misc_feature 1..16: note = Description of sequence: CMP ID NO: 12_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA adenine nucleoside
  modified_base 15: mod_base = OTHER; note = beta-D-oxy-LNA adenine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acacaagtcatgttac

SEQ ID NO: 795 - DNA, 16 bp, synthetic construct
  misc_feature 1..16: note = Description of sequence: CMP ID NO: 13_1
  source 1..16: mol_type = other DNA
  misc_feature 1..2: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cttacttagatgctgc

SEQ ID NO: 796 - DNA, 16 bp, synthetic construct
  misc_feature 1..16: note = Description of sequence: CMP ID NO: 14_1
  source 1..16: mol_type = other DNA
  misc_feature 1..2: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acttacttagatgctg

SEQ ID NO: 797 - DNA, 16 bp, synthetic construct
  misc_feature 1..16: note = Description of sequence: CMP ID NO: 15_1
  source 1..16: mol_type = other DNA
  misc_feature 1..3: note = Backbone sugar is not deoxyribose
  misc_feature 15..16: note = Backbone sugar is not deoxyribose
  modified_base 16: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gacttacttagatgct

SEQ ID NO: 798 - DNA, 16 bp, synthetic construct
  misc_feature 1..16: note = Description of sequence: CMP ID NO: 16_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agacttacttagatgc

SEQ ID NO: 799 - DNA, 16 bp, synthetic construct
  misc_feature 1..16: note = Description of sequence: CMP ID NO: 17_1
  source 1..16: mol_type = other DNA
  misc_feature 1..3: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcaggaagagacttac

SEQ ID NO: 800 - DNA, 17 bp, synthetic construct
  misc_feature 1..17: note = Description of sequence: CMP ID NO: 18_1
  source 1..17: mol_type = other DNA
  misc_feature 1..4: note = Backbone sugar is not deoxyribose
  misc_feature 14..17: note = Backbone sugar is not deoxyribose
  modified_base 3: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
aataaattccgttcagg

SEQ ID NO: 801 - DNA, 16 bp, synthetic construct
  misc_feature 1..16: note = Description of sequence: CMP ID NO: 19_2
  source 1..16: mol_type = other DNA
  misc_feature 1..3: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcaaataaattccgtt

SEQ ID NO: 802 - DNA, 16 bp, synthetic construct
  misc_feature 1..16: note = Description of sequence: CMP ID NO: 19_1
  source 1..16: mol_type = other DNA
  misc_feature 1..4: note = Backbone sugar is not deoxyribose
  misc_feature 13..16: note = Backbone sugar is not deoxyribose
  modified_base 15: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 2: mod_base = OTHER; note = beta-D-oxy-LNA 5-methyl cytosine nucleoside
  modified_base 13: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcaaataaattccgtt

SEQ ID NO: 803 - DNA, 16 bp, synthetic construct
  misc_feature 1..16: note = Description of sequence: CMP ID NO: 20_1
  source 1..16: mol_type = other DNA
  misc_feature 1..4: note = Backbone sugar is not deoxyribose
  misc_feature 14..16: note = Backbone sugar is not deoxyribose
  modified_base 16: mod_base = OTHER; note = beta-D-oxy-LNA thymine nucleoside
  modified_base 1: mod_base = OTHER; note = beta-D-oxy-LNA adenine nucleoside
  modified_base 4: mod_base = OTHER; note = beta-D-oxy-LNA adenine nucleoside
  modified_base 3: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agcaaataaattccgt

SEQ ID NO: 804 - DNA, 17 bp, synthetic construct
  misc_feature 1..17: note = Description of sequence: CMP ID NO: 21_1
  source 1..17: mol_type = other DNA
  misc_feature 1..4: note = Backbone sugar is not deoxyribose
  misc_feature 15..17: note = Backbone sugar is not deoxyribose
  modified_base 15: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
cagagcaaataaattcc

SEQ ID NO: 805 - DNA, 18 bp, synthetic construct
  misc_feature 1..18: note = Description of sequence: CMP ID NO: 22_1
  source 1..18: mol_type = other DNA
  misc_feature 1..4: note = Backbone sugar is not deoxyribose
  misc_feature 16..18: note = Backbone sugar is not deoxyribose
  modified_base 1: mod_base = OTHER; note = beta-D-oxy-LNA thymine nucleoside
  modified_base 18: mod_base = OTHER; note = beta-D-oxy-LNA thymine nucleoside
  modified_base 4: mod_base = OTHER; note = beta-D-oxy-LNA adenine nucleoside
  modified_base 16: mod_base = OTHER; note = beta-D-oxy-LNA adenine nucleoside
  modified_base 17: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tggacagagcaaataaat

SEQ ID NO: 806 - DNA, 16 bp, synthetic construct
  misc_feature 1..16: note = Description of sequence: CMP ID NO: 23_1
  source 1..16: mol_type = other DNA
  misc_feature 1..4: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA adenine nucleoside
  modified_base 13: mod_base = OTHER; note = beta-D-oxy-LNA adenine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atggacagagcaaata

SEQ ID NO: 807 - DNA, 16 bp, synthetic construct
  misc_feature 1..16: note = Description of sequence: CMP ID NO: 24_1
  source 1..16: mol_type = other DNA
  misc_feature 1..2: note = Backbone sugar is not deoxyribose
  misc_feature 14..16: note = Backbone sugar is not deoxyribose
  modified_base 2: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cagaatggacagagca

SEQ ID NO: 808 - DNA, 16 bp, synthetic construct
  misc_feature 1..16: note = Description of sequence: CMP ID NO: 25_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttctcagaatggacag

SEQ ID NO: 809 - DNA, 16 bp, synthetic construct
  misc_feature 1..16: note = Description of sequence: CMP ID NO: 26_1
  source 1..16: mol_type = other DNA
  misc_feature 1..4: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 4: mod_base = OTHER; note = beta-D-oxy-LNA adenine nucleoside
  modified_base 13: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctgaactttgacatag

SEQ ID NO: 810 - DNA, 18 bp, synthetic construct
  misc_feature 1..18: note = Description of sequence: CMP ID NO: 27_1
  source 1..18: mol_type = other DNA
  misc_feature 1..2: note = Backbone sugar is not deoxyribose
  misc_feature 16..18: note = Backbone sugar is not deoxyribose
  modified_base 16: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 18: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
aagacaaacccagactga

SEQ ID NO: 811 - DNA, 18 bp, synthetic construct
  misc_feature 1..18: note = Description of sequence: CMP ID NO: 28_1
  source 1..18: mol_type = other DNA
  misc_feature 1..4: note = Backbone sugar is not deoxyribose
  misc_feature 15..18: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 17: mod_base = OTHER; note = beta-D-oxy-LNA adenine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tataagacaaacccagac

SEQ ID NO: 812 - DNA, 18 bp, synthetic construct
  misc_feature 1..18: note = Description of sequence: CMP ID NO: 29_1
  source 1..18: mol_type = other DNA
  misc_feature 1..4: note = Backbone sugar is not deoxyribose
  misc_feature 15..18: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 4: mod_base = OTHER; note = beta-D-oxy-LNA thymine nucleoside
  modified_base 3: mod_base = OTHER; note = beta-D-oxy-LNA adenine nucleoside
  modified_base 16: mod_base = OTHER; note = beta-D-oxy-LNA adenine nucleoside
  modified_base 18: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
ttataagacaaacccaga

SEQ ID NO: 813 - DNA, 17 bp, synthetic construct
  misc_feature 1..17: note = Description of sequence: CMP ID NO: 30_1
  source 1..17: mol_type = other DNA
  misc_feature 1..4: note = Backbone sugar is not deoxyribose
  misc_feature 15..17: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 4: mod_base = OTHER; note = beta-D-oxy-LNA thymine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tgttataagacaaaccc

SEQ ID NO: 814 - DNA, 17 bp, synthetic construct
  misc_feature 1..17: note = Description of sequence: CMP ID NO: 31_1
  source 1..17: mol_type = other DNA
  misc_feature 1..4: note = Backbone sugar is not deoxyribose
  misc_feature 14..17: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 17: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tagaacaatggtacttt

SEQ ID NO: 815 - DNA, 16 bp, synthetic construct
  misc_feature 1..16: note = Description of sequence: CMP ID NO: 32_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtagaacaatggtact

SEQ ID NO: 816 - DNA, 16 bp, synthetic construct
  misc_feature 1..16: note = Description of sequence: CMP ID NO: 33_1
  source 1..16: mol_type = other DNA
  misc_feature 1..3: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aggtagaacaatggta

SEQ ID NO: 817 - DNA, 17 bp, synthetic construct
  misc_feature 1..17: note = Description of sequence: CMP ID NO: 34_1
  source 1..17: mol_type = other DNA
  misc_feature 1..4: note = Backbone sugar is not deoxyribose
  misc_feature 14..17: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 14: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
aagaggtagaacaatgg

SEQ ID NO: 818 - DNA, 16 bp, synthetic construct
  misc_feature 1..16: note = Description of sequence: CMP ID NO: 35_1
  source 1..16: mol_type = other DNA
  misc_feature 1..2: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcatccacagtaaatt

SEQ ID NO: 819 - DNA, 16 bp, synthetic construct
  misc_feature 1..16: note = Description of sequence: CMP ID NO: 36_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gaaggttatttaattc

SEQ ID NO: 820 - DNA, 16 bp, synthetic construct
  misc_feature 1..16: note = Description of sequence: CMP ID NO: 37_1
  source 1..16: mol_type = other DNA
  misc_feature 1..4: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctaatcgaatgcagca

SEQ ID NO: 821 - DNA, 16 bp, synthetic construct
  misc_feature 1..16: note = Description of sequence: CMP ID NO: 38_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 3: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tacccaatctaatcga

SEQ ID NO: 822 - DNA, 16 bp, synthetic construct
  misc_feature 1..16: note = Description of sequence: CMP ID NO: 39_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tagttacccaatctaa

SEQ ID NO: 823 - DNA, 16 bp, synthetic construct
  misc_feature 1..16: note = Description of sequence: CMP ID NO: 40_1
  source 1..16: mol_type = other DNA
  misc_feature 1..3: note = Backbone sugar is not deoxyribose
  misc_feature 14..16: note = Backbone sugar is not deoxyribose
  modified_base 3: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 14: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
catttagttacccaat

SEQ ID NO: 824 - DNA, 16 bp, synthetic construct
  misc_feature 1..16: note = Description of sequence: CMP ID NO: 41_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcatttagttacccaa

SEQ ID NO: 825 - DNA, 16 bp, synthetic construct
  misc_feature 1..16: note = Description of sequence: CMP ID NO: 42_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 16: mod_base = OTHER; note = beta-D-oxy-LNA adenine nucleoside
  modified_base 13: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttcatttagttaccca

SEQ ID NO: 826 - DNA, 18 bp, synthetic construct
  misc_feature 1..18: note = Description of sequence: CMP ID NO: 43_1
  source 1..18: mol_type = other DNA
  misc_feature 1..4: note = Backbone sugar is not deoxyribose
  misc_feature 15..18: note = Backbone sugar is not deoxyribose
  modified_base 4: mod_base = OTHER; note = beta-D-oxy-LNA thymine nucleoside
  modified_base 15: mod_base = OTHER; note = beta-D-oxy-LNA thymine nucleoside
  modified_base 18: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
gaattaatttcatttagt

SEQ ID NO: 827 - DNA, 17 bp, synthetic construct
  misc_feature 1..17: note = Description of sequence: CMP ID NO: 44_1
  source 1..17: mol_type = other DNA
  misc_feature 1..4: note = Backbone sugar is not deoxyribose
  misc_feature 14..17: note = Backbone sugar is not deoxyribose
  modified_base 4: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 17: mod_base = OTHER; note = beta-D-oxy-LNA thymine nucleoside
  modified_base 2: mod_base = OTHER; note = beta-D-oxy-LNA adenine nucleoside
  modified_base 14: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
cagtgaggaattaattt

SEQ ID NO: 828 - DNA, 16 bp, synthetic construct
  misc_feature 1..16: note = Description of sequence: CMP ID NO: 45_1
  source 1..16: mol_type = other DNA
  misc_feature 1..4: note = Backbone sugar is not deoxyribose
  misc_feature 13..16: note = Backbone sugar is not deoxyribose
  modified_base 15: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 13: mod_base = OTHER; note = beta-D-oxy-LNA adenine nucleoside
  modified_base 14: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ccaacagtgaggaatt

SEQ ID NO: 829 - DNA, 16 bp, synthetic construct
  misc_feature 1..16: note = Description of sequence: CMP ID NO: 46_1
  source 1..16: mol_type = other DNA
  misc_feature 1..3: note = Backbone sugar is not deoxyribose
  misc_feature 14..16: note = Backbone sugar is not deoxyribose
  modified_base 16: mod_base = OTHER; note = beta-D-oxy-LNA thymine nucleoside
  modified_base 14: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cccaacagtgaggaat

SEQ ID NO: 830 - DNA, 17 bp, synthetic construct
  misc_feature 1..17: note = Description of sequence: CMP ID NO: 47_1
  source 1..17: mol_type = other DNA
  misc_feature 1..2: note = Backbone sugar is not deoxyribose
  misc_feature 15..17: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tatacccaacagtgagg

SEQ ID NO: 831 - DNA, 17 bp, synthetic construct
  misc_feature 1..17: note = Description of sequence: CMP ID NO: 48_1
  source 1..17: mol_type = other DNA
  misc_feature 1..2: note = Backbone sugar is not deoxyribose
  misc_feature 14..17: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
ttatacccaacagtgag

SEQ ID NO: 832 - DNA, 17 bp, synthetic construct
  misc_feature 1..17: note = Description of sequence: CMP ID NO: 49_1
  source 1..17: mol_type = other DNA
  misc_feature 1..3: note = Backbone sugar is not deoxyribose
  misc_feature 15..17: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA thymine nucleoside
  modified_base 17: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tttatacccaacagtga

SEQ ID NO: 833 - DNA, 16 bp, synthetic construct
  misc_feature 1..16: note = Description of sequence: CMP ID NO: 50_1
  source 1..16: mol_type = other DNA
  misc_feature 1..3: note = Backbone sugar is not deoxyribose
  misc_feature 14..16: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cctttatacccaacag

SEQ ID NO: 834 - DNA, 16 bp, synthetic construct
  misc_feature 1..16: note = Description of sequence: CMP ID NO: 51_1
  source 1..16: mol_type = other DNA
  misc_feature 1..4: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 4: mod_base = OTHER; note = beta-D-oxy-LNA 5-methyl cytosine nucleoside
  modified_base 13: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
taacctttatacccaa

SEQ ID NO: 835 - DNA, 17 bp, synthetic construct
  misc_feature 1..17: note = Description of sequence: CMP ID NO: 52_1
  source 1..17: mol_type = other DNA
  misc_feature 1..3: note = Backbone sugar is not deoxyribose
  misc_feature 14..17: note = Backbone sugar is not deoxyribose
  modified_base 3: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 17: mod_base = OTHER; note = beta-D-oxy-LNA adenine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
aataacctttataccca

SEQ ID NO: 836 - DNA, 16 bp, synthetic construct
  misc_feature 1..16: note = Description of sequence: CMP ID NO: 53_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 3: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtaaataacctttata

SEQ ID NO: 837 - DNA, 18 bp, synthetic construct
  misc_feature 1..18: note = Description of sequence: CMP ID NO: 54_1
  source 1..18: mol_type = other DNA
  misc_feature 1..4: note = Backbone sugar is not deoxyribose
  misc_feature 15..18: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 18: mod_base = OTHER; note = beta-D-oxy-LNA thymine nucleoside
  modified_base 1: mod_base = OTHER; note = beta-D-oxy-LNA adenine nucleoside
  modified_base 17: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
actgtaaataacctttat

SEQ ID NO: 838 - DNA, 16 bp, synthetic construct
  misc_feature 1..16: note = Description of sequence: CMP ID NO: 55_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atatatatgcaatgag

SEQ ID NO: 839 - DNA, 16 bp, synthetic construct
  misc_feature 1..16: note = Description of sequence: CMP ID NO: 56_1
  source 1..16: mol_type = other DNA
  misc_feature 1..2: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agatatatatgcaatg

SEQ ID NO: 840 - DNA, 16 bp, synthetic construct
  misc_feature 1..16: note = Description of sequence: CMP ID NO: 57_1
  source 1..16: mol_type = other DNA
  misc_feature 1..3: note = Backbone sugar is not deoxyribose
  misc_feature 14..16: note = Backbone sugar is not deoxyribose
  modified_base 16: mod_base = OTHER; note = beta-D-oxy-LNA thymine nucleoside
  modified_base 2: mod_base = OTHER; note = beta-D-oxy-LNA adenine nucleoside
  modified_base 14: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gagatatatatgcaat

SEQ ID NO: 841 - DNA, 16 bp, synthetic construct
  misc_feature 1..16: note = Description of sequence: CMP ID NO: 58_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ccagagatatatatgc

SEQ ID NO: 842 - DNA, 17 bp, synthetic construct
  misc_feature 1..17: note = Description of sequence: CMP ID NO: 59_1
  source 1..17: mol_type = other DNA
  misc_feature 1..4: note = Backbone sugar is not deoxyribose
  misc_feature 14..17: note = Backbone sugar is not deoxyribose
  modified_base 4: mod_base = OTHER; note = beta-D-oxy-LNA thymine nucleoside
  modified_base 15: mod_base = OTHER; note = beta-D-oxy-LNA thymine nucleoside
  modified_base 17: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
caatattccagagatat

SEQ ID NO: 843 - DNA, 17 bp, synthetic construct
  misc_feature 1..17: note = Description of sequence: CMP ID NO: 60_1
  source 1..17: mol_type = other DNA
  misc_feature 1..4: note = Backbone sugar is not deoxyribose
  misc_feature 15..17: note = Backbone sugar is not deoxyribose
  modified_base 16: mod_base = OTHER; note = beta-D-oxy-LNA thymine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 17: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
gcaatattccagagata

SEQ ID NO: 844 - DNA, 17 bp, synthetic construct
  misc_feature 1..17: note = Description of sequence: CMP ID NO: 61_1
  source 1..17: mol_type = other DNA
  misc_feature 1..3: note = Backbone sugar is not deoxyribose
  misc_feature 15..17: note = Backbone sugar is not deoxyribose
  modified_base 17: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
agcaatattccagagat

SEQ ID NO: 845 - DNA, 16 bp, synthetic construct
  misc_feature 1..16: note = Description of sequence: CMP ID NO: 62_1
  source 1..16: mol_type = other DNA
  misc_feature 1..3: note = Backbone sugar is not deoxyribose
  misc_feature 13..16: note = Backbone sugar is not deoxyribose
  modified_base 2: mod_base = OTHER; note = beta-D-oxy-LNA adenine nucleoside
  modified_base 13: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cagcaatattccagag

SEQ ID NO: 846 - DNA, 17 bp, synthetic construct
  misc_feature 1..17: note = Description of sequence: CMP ID NO: 63_1
  source 1..17: mol_type = other DNA
  misc_feature 1..4: note = Backbone sugar is not deoxyribose
  misc_feature 14..17: note = Backbone sugar is not deoxyribose
  modified_base 3: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 4: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
aatcagcaatattccag

SEQ ID NO: 847 - DNA, 17 bp, synthetic construct
  misc_feature 1..17: note = Description of sequence: CMP ID NO: 64_1
  source 1..17: mol_type = other DNA
  misc_feature 1..4: note = Backbone sugar is not deoxyribose
  misc_feature 14..17: note = Backbone sugar is not deoxyribose
  modified_base 14: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
acaatcagcaatattcc

SEQ ID NO: 848 - DNA, 19 bp, synthetic construct
  misc_feature 1..19: note = Description of sequence: CMP ID NO: 65_1
  source 1..19: mol_type = other DNA
  misc_feature 1..2: note = Backbone sugar is not deoxyribose
  misc_feature 17..19: note = Backbone sugar is not deoxyribose
  modified_base 17: mod_base = OTHER; note = beta-D-oxy-LNA thymine nucleoside
  modified_base 19: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA 5-methyl cytosine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
actaagtagttacacttct

SEQ ID NO: 849 - DNA, 17 bp, synthetic construct
  misc_feature 1..17: note = Description of sequence: CMP ID NO: 66_1
  source 1..17: mol_type = other DNA
  misc_feature 1..4: note = Backbone sugar is not deoxyribose
  misc_feature 16..17: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 1: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
ctaagtagttacacttc

SEQ ID NO: 850 - DNA, 18 bp, synthetic construct
  misc_feature 1..18: note = Description of sequence: CMP ID NO: 67_1
  source 1..18: mol_type = other DNA
  misc_feature 1..3: note = Backbone sugar is not deoxyribose
  misc_feature 16..18: note = Backbone sugar is not deoxyribose
  modified_base 17: mod_base = OTHER; note = beta-D-oxy-LNA thymine nucleoside
  modified_base 18: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
gactaagtagttacactt

SEQ ID NO: 851 - DNA, 16 bp, synthetic construct
  misc_feature 1..16: note = Description of sequence: CMP ID NO: 68_1
  source 1..16: mol_type = other DNA
  misc_feature 1..3: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 13: mod_base = OTHER; note = beta-D-oxy-LNA thymine nucleoside
  modified_base 3: mod_base = OTHER; note = beta-D-oxy-LNA adenine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgactaagtagttaca

SEQ ID NO: 852 - DNA, 17 bp, synthetic construct
  misc_feature 1..17: note = Description of sequence: CMP ID NO: 69_1
  source 1..17: mol_type = other DNA
  misc_feature 1..4: note = Backbone sugar is not deoxyribose
  misc_feature 15..17: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 4: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 17: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
ctttgactaagtagtta

SEQ ID NO: 853 - DNA, 16 bp, synthetic construct
  misc_feature 1..16: note = Description of sequence: CMP ID NO: 70_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctctttgactaagtag

SEQ ID NO: 854 - DNA, 16 bp, synthetic construct
  misc_feature 1..16: note = Description of sequence: CMP ID NO: 71_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gctctttgactaagta

SEQ ID NO: 855 - DNA, 17 bp, synthetic construct
  misc_feature 1..17: note = Description of sequence: CMP ID NO: 72_1
  source 1..17: mol_type = other DNA
  misc_feature 1..2: note = Backbone sugar is not deoxyribose
  misc_feature 14..17: note = Backbone sugar is not deoxyribose
  modified_base 14: mod_base = OTHER; note = beta-D-oxy-LNA thymine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
ccttaaatactgttgac

SEQ ID NO: 856 - DNA, 16 bp, synthetic construct
  misc_feature 1..16: note = Description of sequence: CMP ID NO: 73_1
  source 1..16: mol_type = other DNA
  misc_feature 1..2: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cttaaatactgttgac

SEQ ID NO: 857 - DNA, 16 bp, synthetic construct
  misc_feature 1..16: note = Description of sequence: CMP ID NO: 74_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tccttaaatactgttg

SEQ ID NO: 858 - DNA, 17 bp, synthetic construct
  misc_feature 1..17: note = Description of sequence: CMP ID NO: 75_1
  source 1..17: mol_type = other DNA
  misc_feature 1..4: note = Backbone sugar is not deoxyribose
  misc_feature 16..17: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 16: mod_base = OTHER; note = beta-D-oxy-LNA thymine nucleoside
  modified_base 17: mod_base = OTHER; note = beta-D-oxy-LNA thymine nucleoside
  modified_base 2: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tctccttaaatactgtt

SEQ ID NO: 859 - DNA, 16 bp, synthetic construct
  misc_feature 1..16: note = Description of sequence: CMP ID NO: 76_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 13: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tatcatagttctcctt

SEQ ID NO: 860 - DNA, 16 bp, synthetic construct
  misc_feature 1..16: note = Description of sequence: CMP ID NO: 77_1
  source 1..16: mol_type = other DNA
  misc_feature 1..3: note = Backbone sugar is not deoxyribose
  misc_feature 14..16: note = Backbone sugar is not deoxyribose
  modified_base 3: mod_base = OTHER; note = beta-D-oxy-LNA thymine nucleoside
  modified_base 14: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agtatcatagttctcc

SEQ ID NO: 861 - DNA, 16 bp, synthetic construct
  misc_feature 1..16: note = Description of sequence: CMP ID NO: 78_1
  source 1..16: mol_type = other DNA
  misc_feature 1..2: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 2: mod_base = OTHER; note = beta-D-oxy-LNA adenine nucleoside
  modified_base 14: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gagtatcatagttctc

SEQ ID NO: 862 - DNA, 16 bp, synthetic construct
  misc_feature 1..16: note = Description of sequence: CMP ID NO: 79_1
  source 1..16: mol_type = other DNA
  misc_feature 1..2: note = Backbone sugar is not deoxyribose
  misc_feature 13..16: note = Backbone sugar is not deoxyribose
  modified_base 13: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agagtatcatagttct

SEQ ID NO: 863 - DNA, 16 bp, synthetic construct
  misc_feature 1..16: note = Description of sequence: CMP ID NO: 79_2
  source 1..16: mol_type = other DNA
  misc_feature 1..3: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agagtatcatagttct

SEQ ID NO: 864 - DNA, 16 bp, synthetic construct
  misc_feature 1..16: note = Description of sequence: CMP ID NO: 80_1
  source 1..16: mol_type = other DNA
  misc_feature 1..3: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cagagtatcatagttc

SEQ ID NO: 865 - DNA, 16 bp, synthetic construct
  misc_feature 1..16: note = Description of sequence: CMP ID NO: 81_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 16: mod_base = OTHER; note = beta-D-oxy-LNA thymine nucleoside
  modified_base 4: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttcagagtatcatagt

SEQ ID NO: 866 - DNA, 16 bp, synthetic construct
  misc_feature 1..16: note = Description of sequence: CMP ID NO: 82_1
  source 1..16: mol_type = other DNA
  misc_feature 1..3: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 14: mod_base = OTHER; note = beta-D-oxy-LNA thymine nucleoside
  modified_base 13: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cttcagagtatcatag

SEQ ID NO: 867 - DNA, 17 bp, synthetic construct
  misc_feature 1..17: note = Description of sequence: CMP ID NO: 83_1
  source 1..17: mol_type = other DNA
  misc_feature 1..4: note = Backbone sugar is not deoxyribose
  misc_feature 16..17: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 4: mod_base = OTHER; note = beta-D-oxy-LNA thymine nucleoside
  modified_base 16: mod_base = OTHER; note = beta-D-oxy-LNA thymine nucleoside
  modified_base 17: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
ttcttcagagtatcata

SEQ ID NO: 868 - DNA, 17 bp, synthetic construct
  misc_feature 1..17: note = Description of sequence: CMP ID NO: 84_1
  source 1..17: mol_type = other DNA
  misc_feature 1..3: note = Backbone sugar is not deoxyribose
  misc_feature 14..17: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA thymine nucleoside
  modified_base 14: mod_base = OTHER; note = beta-D-oxy-LNA thymine nucleoside
  modified_base 17: mod_base = OTHER; note = beta-D-oxy-LNA thymine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tttcttcagagtatcat

SEQ ID NO: 869 - DNA, 16 bp, synthetic construct
  misc_feature 1..16: note = Description of sequence: CMP ID NO: 85_1
  source 1..16: mol_type = other DNA
  misc_feature 1..4: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gagaaaggctaagttt

SEQ ID NO: 870 - DNA, 16 bp, synthetic construct
  misc_feature 1..16: note = Description of sequence: CMP ID NO: 86_1
  source 1..16: mol_type = other DNA
  misc_feature 1..2: note = Backbone sugar is not deoxyribose
  misc_feature 13..16: note = Backbone sugar is not deoxyribose
  modified_base 15: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 14: mod_base = OTHER; note = beta-D-oxy-LNA adenine nucleoside
  modified_base 13: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gacactcttgtacatt

SEQ ID NO: 871 - DNA, 17 bp, synthetic construct
  misc_feature 1..17: note = Description of sequence: CMP ID NO: 87_1
  source 1..17: mol_type = other DNA
  misc_feature 1..2: note = Backbone sugar is not deoxyribose
  misc_feature 16..17: note = Backbone sugar is not deoxyribose
  modified_base 1: mod_base = OTHER; note = beta-D-oxy-LNA thymine nucleoside
  modified_base 17: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tgagacactcttgtaca

SEQ ID NO: 872 - DNA, 16 bp, synthetic construct
  misc_feature 1..16: note = Description of sequence: CMP ID NO: 88_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgagacactcttgtac

SEQ ID NO: 873 - DNA, 16 bp, synthetic construct
  misc_feature 1..16: note = Description of sequence: CMP ID NO: 89_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 13: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctttattaaactccat

SEQ ID NO: 874 - DNA, 16 bp, synthetic construct
  misc_feature 1..16: note = Description of sequence: CMP ID NO: 90_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA adenine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
accaaactttattaaa

SEQ ID NO: 875 - DNA, 16 bp, synthetic construct
  misc_feature 1..16: note = Description of sequence: CMP ID NO: 91_1
  source 1..16: mol_type = other DNA
  misc_feature 1..4: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aaacctctactaagtg

SEQ ID NO: 876 - DNA, 16 bp, synthetic construct
  misc_feature 1..16: note = Description of sequence: CMP ID NO: 92_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agattaagacagttga

SEQ ID NO: 877 - DNA, 17 bp, synthetic construct
  misc_feature 1..17: note = Description of sequence: CMP ID NO: 93_1
  source 1..17: mol_type = other DNA
  misc_feature 1..2: note = Backbone sugar is not deoxyribose
  misc_feature 15..17: note = Backbone sugar is not deoxyribose
  modified_base 1: mod_base = OTHER; note = beta-D-oxy-LNA adenine nucleoside
  modified_base 2: mod_base = OTHER; note = beta-D-oxy-LNA adenine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
aagtaggagcaagaggc

SEQ ID NO: 878 - DNA, 17 bp, synthetic construct
  misc_feature 1..17: note = Description of sequence: CMP ID NO: 94_1
  source 1..17: mol_type = other DNA
  misc_feature 1..4: note = Backbone sugar is not deoxyribose
  misc_feature 15..17: note = Backbone sugar is not deoxyribose
  modified_base 1: mod_base = OTHER; note = beta-D-oxy-LNA adenine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
aaagtaggagcaagagg

SEQ ID NO: 879 - DNA, 16 bp, synthetic construct
  misc_feature 1..16: note = Description of sequence: CMP ID NO: 95_1
  source 1..16: mol_type = other DNA
  misc_feature 1..2: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gttaagcagccaggag

SEQ ID NO: 880 - DNA, 16 bp, synthetic construct
  misc_feature 1..16: note = Description of sequence: CMP ID NO: 96_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agggtaggatgggtag

SEQ ID NO: 881 - DNA, 16 bp, synthetic construct
  misc_feature 1..16: note = Description of sequence: CMP ID NO: 97_1
  source 1..16: mol_type = other DNA
  misc_feature 1..3: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aagggtaggatgggta

SEQ ID NO: 882 - DNA, 16 bp, synthetic construct
  misc_feature 1..16: note = Description of sequence: CMP ID NO: 98_2
  source 1..16: mol_type = other DNA
  misc_feature 1..2: note = Backbone sugar is not deoxyribose
  misc_feature 15..16: note = Backbone sugar is not deoxyribose
  modified_base 16: mod_base = OTHER; note = beta-D-oxy-LNA thymine nucleoside
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
caagggtaggatgggt

SEQ ID NO: 883 - DNA, 16 bp, synthetic construct
  misc_feature 1..16: note = Description of sequence: CMP ID NO: 98_1
  source 1..16: mol_type = other DNA
  misc_feature 1..3: note = Backbone sugar is not deoxyribose
  misc_feature 15..16: note = Backbone sugar is not deoxyribose
  modified_base 16: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
caagggtaggatgggt

SEQ ID NO: 884 - DNA, 16 bp, synthetic construct
  misc_feature 1..16: note = Description of sequence: CMP ID NO: 99_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ccaagggtaggatggg

SEQ ID NO: 885 - DNA, 16 bp, synthetic construct
  misc_feature 1..16: note = Description of sequence: CMP ID NO: 100_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tccaagggtaggatgg

SEQ ID NO: 886 - DNA, 16 bp, synthetic construct
  misc_feature 1..16: note = Description of sequence: CMP ID NO: 101_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 16: mod_base = OTHER; note = beta-D-oxy-LNA thymine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cttccaagggtaggat

SEQ ID NO: 887 - DNA, 17 bp, synthetic construct
  misc_feature 1..17: note = Description of sequence: CMP ID NO: 102_1
  source 1..17: mol_type = other DNA
  misc_feature 1..3: note = Backbone sugar is not deoxyribose
  misc_feature 16..17: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 17: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
atcttccaagggtagga

SEQ ID NO: 888 - DNA, 17 bp, synthetic construct
  misc_feature 1..17: note = Description of sequence: CMP ID NO: 103_1
  source 1..17: mol_type = other DNA
  misc_feature 1..2: note = Backbone sugar is not deoxyribose
  misc_feature 14..17: note = Backbone sugar is not deoxyribose
  modified_base 16: mod_base = OTHER; note = beta-D-oxy-LNA thymine nucleoside
  modified_base 17: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
agaagtgatggctcatt

SEQ ID NO: 889 - DNA, 17 bp, synthetic construct
  misc_feature 1..17: note = Description of sequence: CMP ID NO: 104_1
  source 1..17: mol_type = other DNA
  misc_feature 1..3: note = Backbone sugar is not deoxyribose
  misc_feature 14..17: note = Backbone sugar is not deoxyribose
  modified_base 14: mod_base = OTHER; note = beta-D-oxy-LNA thymine nucleoside
  modified_base 17: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
aagaagtgatggctcat

SEQ ID NO: 890 - DNA, 17 bp, synthetic construct
  misc_feature 1..17: note = Description of sequence: CMP ID NO: 105_1
  source 1..17: mol_type = other DNA
  misc_feature 1..3: note = Backbone sugar is not deoxyribose
  misc_feature 15..17: note = Backbone sugar is not deoxyribose
  modified_base 15: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 17: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
gaagaagtgatggctca

SEQ ID NO: 891 - DNA, 17 bp, synthetic construct
  misc_feature 1..17: note = Description of sequence: CMP ID NO: 106_1
  source 1..17: mol_type = other DNA
  misc_feature 1..4: note = Backbone sugar is not deoxyribose
  misc_feature 14..17: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 1: mod_base = OTHER; note = beta-D-oxy-LNA adenine nucleoside
  modified_base 4: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
atgaaatgtaaactggg

SEQ ID NO: 892 - DNA, 18 bp, synthetic construct
  misc_feature 1..18: note = Description of sequence: CMP ID NO: 107_1
  source 1..18: mol_type = other DNA
  misc_feature 1..4: note = Backbone sugar is not deoxyribose
  misc_feature 15..18: note = Backbone sugar is not deoxyribose
  modified_base 4: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 1: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
caatgaaatgtaaactgg

SEQ ID NO: 893 - DNA, 18 bp, synthetic construct
  misc_feature 1..18: note = Description of sequence: CMP ID NO: 108_1
  source 1..18: mol_type = other DNA
  misc_feature 1..4: note = Backbone sugar is not deoxyribose
  misc_feature 15..18: note = Backbone sugar is not deoxyribose
  modified_base 17: mod_base = OTHER; note = beta-D-oxy-LNA thymine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
gcaatgaaatgtaaactg

SEQ ID NO: 894 - DNA, 18 bp, synthetic construct
  misc_feature 1..18: note = Description of sequence: CMP ID NO: 109_1
  source 1..18: mol_type = other DNA
  misc_feature 1..4: note = Backbone sugar is not deoxyribose
  misc_feature 15..18: note = Backbone sugar is not deoxyribose
  modified_base 18: mod_base = OTHER; note = beta-D-oxy-LNA thymine nucleoside
  modified_base 1: mod_base = OTHER; note = beta-D-oxy-LNA adenine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 3: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
agcaatgaaatgtaaact

SEQ ID NO: 895 - DNA, 18 bp, synthetic construct
  misc_feature 1..18: note = Description of sequence: CMP ID NO: 110_1
  source 1..18: mol_type = other DNA
  misc_feature 1..4: note = Backbone sugar is not deoxyribose
  misc_feature 15..18: note = Backbone sugar is not deoxyribose
  modified_base 2: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 17: mod_base = OTHER; note = beta-D-oxy-LNA adenine nucleoside
  modified_base 4: mod_base = OTHER; note = beta-D-oxy-LNA 5-methyl cytosine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
gagcaatgaaatgtaaac

SEQ ID NO: 896 - DNA, 17 bp, synthetic construct
  misc_feature 1..17: note = Description of sequence: CMP ID NO: 111_1
  source 1..17: mol_type = other DNA
  misc_feature 1..2: note = Backbone sugar is not deoxyribose
  misc_feature 15..17: note = Backbone sugar is not deoxyribose
  modified_base 1: mod_base = OTHER; note = beta-D-oxy-LNA thymine nucleoside
  modified_base 17: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tgaattcccatatccga

SEQ ID NO: 897 - DNA, 16 bp, synthetic construct
  misc_feature 1..16: note = Description of sequence: CMP ID NO: 112_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agaattatgaccatat

SEQ ID NO: 898 - DNA, 17 bp, synthetic construct
  misc_feature 1..17: note = Description of sequence: CMP ID NO: 113_1
  source 1..17: mol_type = other DNA
  misc_feature 1..3: note = Backbone sugar is not deoxyribose
  misc_feature 14..17: note = Backbone sugar is not deoxyribose
  modified_base 1: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
aggtaagaattatgacc

SEQ ID NO: 899 - DNA, 18 bp, synthetic construct
  misc_feature 1..18: note = Description of sequence: CMP ID NO: 114_1
  source 1..18: mol_type = other DNA
  misc_feature 1..4: note = Backbone sugar is not deoxyribose
  misc_feature 15..18: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 3: mod_base = OTHER; note = beta-D-oxy-LNA adenine nucleoside
  modified_base 17: mod_base = OTHER; note = beta-D-oxy-LNA adenine nucleoside
  modified_base 2: mod_base = OTHER; note = beta-D-oxy-LNA 5-methyl cytosine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tcaggtaagaattatgac

SEQ ID NO: 900 - DNA, 18 bp, synthetic construct
  misc_feature 1..18: note = Description of sequence: CMP ID NO: 115_1
  source 1..18: mol_type = other DNA
  misc_feature 1..4: note = Backbone sugar is not deoxyribose
  misc_feature 15..18: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA thymine nucleoside
  modified_base 17: mod_base = OTHER; note = beta-D-oxy-LNA thymine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
cttcaggtaagaattatg

SEQ ID NO: 901 - DNA, 17 bp, synthetic construct
  misc_feature 1..17: note = Description of sequence: CMP ID NO: 116_1
  source 1..17: mol_type = other DNA
  misc_feature 1..4: note = Backbone sugar is not deoxyribose
  misc_feature 14..17: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 4: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 14: mod_base = OTHER; note = beta-D-oxy-LNA adenine nucleoside
  modified_base 17: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tcttcaggtaagaatta

SEQ ID NO: 902 - DNA, 17 bp, synthetic construct
  misc_feature 1..17: note = Description of sequence: CMP ID NO: 117_1
  source 1..17: mol_type = other DNA
  misc_feature 1..4: note = Backbone sugar is not deoxyribose
  misc_feature 14..17: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 17: mod_base = OTHER; note = beta-D-oxy-LNA thymine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
cttcttcaggtaagaat

SEQ ID NO: 903 - DNA, 17 bp, synthetic construct
  misc_feature 1..17: note = Description of sequence: CMP ID NO: 118_1
  source 1..17: mol_type = other DNA
  misc_feature 1..4: note = Backbone sugar is not deoxyribose
  misc_feature 15..17: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 4: mod_base = OTHER; note = beta-D-oxy-LNA thymine nucleoside
  modified_base 16: mod_base = OTHER; note = beta-D-oxy-LNA adenine nucleoside
  modified_base 17: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tcttcttcaggtaagaa

SEQ ID NO: 904 - DNA, 16 bp, synthetic construct
  misc_feature 1..16: note = Description of sequence: CMP ID NO: 119_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcttcttcaggtaaga

SEQ ID NO: 905 - DNA, 17 bp, synthetic construct
  misc_feature 1..17: note = Description of sequence: CMP ID NO: 120_1
  source 1..17: mol_type = other DNA
  misc_feature 1..3: note = Backbone sugar is not deoxyribose
  misc_feature 14..17: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tggtctaagagaagaag

SEQ ID NO: 906 - DNA, 16 bp, synthetic construct
  misc_feature 1..16: note = Description of sequence: CMP ID NO: 121_1
  source 1..16: mol_type = other DNA
  misc_feature 1..4: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 14: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gttggtctaagagaag

SEQ ID NO: 907 - DNA, 17 bp, synthetic construct
  misc_feature 1..17: note = Description of sequence: CMP ID NO: 123_1
  source 1..17: mol_type = other DNA
  misc_feature 1..2: note = Backbone sugar is not deoxyribose
  misc_feature 14..17: note = Backbone sugar is not deoxyribose
  modified_base 2: mod_base = OTHER; note = beta-D-oxy-LNA adenine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  modified_base 17: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
cagttggtctaagagaa

SEQ ID NO: 908 - DNA, 18 bp, synthetic construct
  misc_feature 1..18: note = Description of sequence: CMP ID NO: 124_1
  source 1..18: mol_type = other DNA
  misc_feature 1..3: note = Backbone sugar is not deoxyribose
  misc_feature 17..18: note = Backbone sugar is not deoxyribose
  modified_base 3: mod_base = OTHER; note = beta-D-oxy-LNA adenine nucleoside
  modified_base 17: mod_base = OTHER; note = beta-D-oxy-LNA adenine nucleoside
  modified_base 18: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
gcagttggtctaagagaa

SEQ ID NO: 909 - DNA, 16 bp, synthetic construct
  misc_feature 1..16: note = Description of sequence: CMP ID NO: 122_1
  source 1..16: mol_type = other DNA
  misc_feature 1..3: note = Backbone sugar is not deoxyribose
  misc_feature 13..16: note = Backbone sugar is not deoxyribose
  modified_base 3: mod_base = OTHER; note = beta-D-oxy-LNA thymine nucleoside
  modified_base 1: mod_base = OTHER; note = beta-D-oxy-LNA adenine nucleoside
  modified_base 13: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agttggtctaagagaa

SEQ ID NO: 910 - DNA, 17 bp, synthetic construct
  misc_feature 1..17: note = Description of sequence: CMP ID NO: 126_1
  source 1..17: mol_type = other DNA
  misc_feature 1..2: note = Backbone sugar is not deoxyribose
  misc_feature 16..17: note = Backbone sugar is not deoxyribose
  modified_base 17: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
gcagttggtctaagaga

SEQ ID NO: 911 - DNA, 16 bp, synthetic construct
  misc_feature 1..16: note = Description of sequence: CMP ID NO: 125_1
  source 1..16: mol_type = other DNA
  misc_feature 1..4: note = Backbone sugar is not deoxyribose
  misc_feature 15..16: note = Backbone sugar is not deoxyribose
  modified_base 4: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cagttggtctaagaga

SEQ ID NO: 912 - DNA, 16 bp, synthetic construct
  misc_feature 1..16: note = Description of sequence: CMP ID NO: 127_1
  source 1..16: mol_type = other DNA
  misc_feature 1..2: note = Backbone sugar is not deoxyribose
  misc_feature 14..16: note = Backbone sugar is not deoxyribose
  modified_base 15: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcagttggtctaagag

SEQ ID NO: 913 - DNA, 16 bp, synthetic construct
  misc_feature 1..16: note = Description of sequence: CMP ID NO: 128_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 14: mod_base = OTHER; note = beta-D-oxy-LNA adenine nucleoside
  modified_base 1: mod_base = OTHER; note = beta-D-oxy-LNA 5-methyl cytosine nucleoside
  modified_base 13: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctcatatcagggcagt

SEQ ID NO: 914 - DNA, 17 bp, synthetic construct
  misc_feature 1..17: note = Description of sequence: CMP ID NO: 129_1
  source 1..17: mol_type = other DNA
  misc_feature 1..4: note = Backbone sugar is not deoxyribose
  misc_feature 16..17: note = Backbone sugar is not deoxyribose
  modified_base 2: mod_base = OTHER; note = beta-D-oxy-LNA adenine nucleoside
  modified_base 4: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
cacacatgttctttaac

SEQ ID NO: 915 - DNA, 18 bp, synthetic construct
  misc_feature 1..18: note = Description of sequence: CMP ID NO: 130_1
  source 1..18: mol_type = other DNA
  misc_feature 1..3: note = Backbone sugar is not deoxyribose
  misc_feature 15..18: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 18: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
taaatacacacatgttct

SEQ ID NO: 916 - DNA, 18 bp, synthetic construct
  misc_feature 1..18: note = Description of sequence: CMP ID NO: 131_1
  source 1..18: mol_type = other DNA
  misc_feature 1..4: note = Backbone sugar is not deoxyribose
  misc_feature 16..18: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 17: mod_base = OTHER; note = beta-D-oxy-LNA thymine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
gtaaatacacacatgttc

SEQ ID NO: 917 - DNA, 18 bp, synthetic construct
  misc_feature 1..18: note = Description of sequence: CMP ID NO: 132_1
  source 1..18: mol_type = other DNA
  misc_feature 1..4: note = Backbone sugar is not deoxyribose
  misc_feature 15..18: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA thymine nucleoside
  modified_base 17: mod_base = OTHER; note = beta-D-oxy-LNA thymine nucleoside
  modified_base 18: mod_base = OTHER; note = beta-D-oxy-LNA thymine nucleoside
  modified_base 4: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tgtaaatacacacatgtt

SEQ ID NO: 918 - DNA, 18 bp, synthetic construct
  misc_feature 1..18: note = Description of sequence: CMP ID NO: 133_1
  source 1..18: mol_type = other DNA
  misc_feature 1..4: note = Backbone sugar is not deoxyribose
  misc_feature 15..18: note = Backbone sugar is not deoxyribose
  modified_base 3: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 17: mod_base = OTHER; note = beta-D-oxy-LNA adenine nucleoside
  modified_base 4: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
gatcatgtaaatacacac

SEQ ID NO: 919 - DNA, 18 bp, synthetic construct
  misc_feature 1..18: note = Description of sequence: CMP ID NO: 134_1
  source 1..18: mol_type = other DNA
  misc_feature 1..4: note = Backbone sugar is not deoxyribose
  misc_feature 15..18: note = Backbone sugar is not deoxyribose
  modified_base 4: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 16: mod_base = OTHER; note = beta-D-oxy-LNA adenine nucleoside
  modified_base 18: mod_base = OTHER; note = beta-D-oxy-LNA adenine nucleoside
  modified_base 15: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
agatcatgtaaatacaca

SEQ ID NO: 920 - DNA, 20 bp, synthetic construct
  misc_feature 1..20: note = Description of sequence: CMP ID NO: 135_1
  source 1..20: mol_type = other DNA
  misc_feature 1..4: note = Backbone sugar is not deoxyribose
  misc_feature 17..20: note = Backbone sugar is not deoxyribose
  modified_base 2: mod_base = OTHER; note = beta-D-oxy-LNA adenine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 17: mod_base = OTHER; note = beta-D-oxy-LNA adenine nucleoside
  modified_base 19: mod_base = OTHER; note = beta-D-oxy-LNA adenine nucleoside
  modified_base 1: mod_base = OTHER; note = beta-D-oxy-LNA 5-methyl cytosine nucleoside
  modified_base 18: mod_base = OTHER; note = beta-D-oxy-LNA 5-methyl cytosine nucleoside
  modified_base 20: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
caaagatcatgtaaatacac

SEQ ID NO: 921 - DNA, 20 bp, synthetic construct
  misc_feature 1..20: note = Description of sequence: CMP ID NO: 136_1
  source 1..20: mol_type = other DNA
  misc_feature 1..4: note = Backbone sugar is not deoxyribose
  misc_feature 17..20: note = Backbone sugar is not deoxyribose
  modified_base 17: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 18: mod_base = OTHER; note = beta-D-oxy-LNA adenine nucleoside
  modified_base 20: mod_base = OTHER; note = beta-D-oxy-LNA adenine nucleoside
  modified_base 2: mod_base = OTHER; note = beta-D-oxy-LNA 5-methyl cytosine nucleoside
  modified_base 19: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
acaaagatcatgtaaataca

SEQ ID NO: 922 - DNA, 18 bp, synthetic construct
  misc_feature 1..18: note = Description of sequence: CMP ID NO: 137_1
  source 1..18: mol_type = other DNA
  misc_feature 1..4: note = Backbone sugar is not deoxyribose
  misc_feature 15..18: note = Backbone sugar is not deoxyribose
  modified_base 4: mod_base = OTHER; note = beta-D-oxy-LNA thymine nucleoside
  modified_base 15: mod_base = OTHER; note = beta-D-oxy-LNA thymine nucleoside
  modified_base 17: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 18: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
gaatacaaagatcatgta

SEQ ID NO: 923 - DNA, 18 bp, synthetic construct
  misc_feature 1..18: note = Description of sequence: CMP ID NO: 138_1
  source 1..18: mol_type = other DNA
  misc_feature 1..4: note = Backbone sugar is not deoxyribose
  misc_feature 15..18: note = Backbone sugar is not deoxyribose
  modified_base 16: mod_base = OTHER; note = beta-D-oxy-LNA thymine nucleoside
  modified_base 18: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
agaatacaaagatcatgt

SEQ ID NO: 924 - DNA, 18 bp, synthetic construct
  misc_feature 1..18: note = Description of sequence: CMP ID NO: 139_1
  source 1..18: mol_type = other DNA
  misc_feature 1..4: note = Backbone sugar is not deoxyribose
  misc_feature 15..18: note = Backbone sugar is not deoxyribose
  modified_base 17: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
cagaatacaaagatcatg

SEQ ID NO: 925 - DNA, 17 bp, synthetic construct
  misc_feature 1..17: note = Description of sequence: CMP ID NO: 140_1
  source 1..17: mol_type = other DNA
  misc_feature 1..4: note = Backbone sugar is not deoxyribose
  misc_feature 14..17: note = Backbone sugar is not deoxyribose
  modified_base 15: mod_base = OTHER; note = beta-D-oxy-LNA thymine nucleoside
  modified_base 3: mod_base = OTHER; note = beta-D-oxy-LNA adenine nucleoside
  modified_base 14: mod_base = OTHER; note = beta-D-oxy-LNA adenine nucleoside
  modified_base 17: mod_base = OTHER; note = beta-D-oxy-LNA adenine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
gcagaatacaaagatca

SEQ ID NO: 926 - DNA, 17 bp, synthetic construct
  misc_feature 1..17: note = Description of sequence: CMP ID NO: 141_1
  source 1..17: mol_type = other DNA
  misc_feature 1..4: note = Backbone sugar is not deoxyribose
  misc_feature 16..17: note = Backbone sugar is not deoxyribose
  modified_base 17: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
aggcagaatacaaagat

SEQ ID NO: 927 - DNA, 17 bp, synthetic construct
  misc_feature 1..17: note = Description of sequence: CMP ID NO: 142_1
  source 1..17: mol_type = other DNA
  misc_feature 1..4: note = Backbone sugar is not deoxyribose
  misc_feature 15..17: note = Backbone sugar is not deoxyribose
  modified_base 1: mod_base = OTHER; note = beta-D-oxy-LNA adenine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 17: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
aaggcagaatacaaaga

SEQ ID NO: 928 - DNA, 16 bp, synthetic construct
  misc_feature 1..16: note = Description of sequence: CMP ID NO: 143_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
attagtgagggacgaa

SEQ ID NO: 929 - DNA, 16 bp, synthetic construct
  misc_feature 1..16: note = Description of sequence: CMP ID NO: 144_1
  source 1..16: mol_type = other DNA
  misc_feature 1..2: note = Backbone sugar is not deoxyribose
  misc_feature 14..16: note = Backbone sugar is not deoxyribose
  modified_base 2: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cattagtgagggacga

SEQ ID NO: 930 - DNA, 16 bp, synthetic construct
  misc_feature 1..16: note = Description of sequence: CMP ID NO: 145_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gagggtgatggattag

SEQ ID NO: 931 - DNA, 16 bp, synthetic construct
  misc_feature 1..16: note = Description of sequence: CMP ID NO: 146_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 13: mod_base = OTHER; note = beta-D-oxy-LNA adenine nucleoside
  modified_base 14: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttaggagtaataaagg

SEQ ID NO: 932 - DNA, 16 bp, synthetic construct
  misc_feature 1..16: note = Description of sequence: CMP ID NO: 147_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA thymine nucleoside
  modified_base 3: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttaatgaatttggttg

SEQ ID NO: 933 - DNA, 16 bp, synthetic construct
  misc_feature 1..16: note = Description of sequence: CMP ID NO: 148_1
  source 1..16: mol_type = other DNA
  misc_feature 1..2: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctttaatgaatttggt

SEQ ID NO: 934 - DNA, 16 bp, synthetic construct
  misc_feature 1..16: note = Description of sequence: CMP ID NO: 149_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
catggattacaactaa

SEQ ID NO: 935 - DNA, 16 bp, synthetic construct
  misc_feature 1..16: note = Description of sequence: CMP ID NO: 150_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcatggattacaacta

SEQ ID NO: 936 - DNA, 16 bp, synthetic construct
  misc_feature 1..16: note = Description of sequence: CMP ID NO: 151_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtcatggattacaact

SEQ ID NO: 937 - DNA, 16 bp, synthetic construct
  misc_feature 1..16: note = Description of sequence: CMP ID NO: 152_1
  source 1..16: mol_type = other DNA
  misc_feature 1..2: note = Backbone sugar is not deoxyribose
  misc_feature 13..16: note = Backbone sugar is not deoxyribose
  modified_base 13: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cattaaatctagtcat

SEQ ID NO: 938 - DNA, 17 bp, synthetic construct
  misc_feature 1..17: note = Description of sequence: CMP ID NO: 153_1
  source 1..17: mol_type = other DNA
  misc_feature 1..4: note = Backbone sugar is not deoxyribose
  misc_feature 15..17: note = Backbone sugar is not deoxyribose
  modified_base 15: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 17: mod_base = OTHER; note = beta-D-oxy-LNA adenine nucleoside
  modified_base 3: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
gacattaaatctagtca

SEQ ID NO: 939 - DNA, 16 bp, synthetic construct
  misc_feature 1..16: note = Description of sequence: CMP ID NO: 154_1
  source 1..16: mol_type = other DNA
  misc_feature 1..4: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agggacattaaatcta

SEQ ID NO: 940 - DNA, 16 bp, synthetic construct
  misc_feature 1..16: note = Description of sequence: CMP ID NO: 155_1
  source 1..16: mol_type = other DNA
  misc_feature 1..4: note = Backbone sugar is not deoxyribose
  misc_feature 14..16: note = Backbone sugar is not deoxyribose
  modified_base 2: mod_base = OTHER; note = beta-D-oxy-LNA adenine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
caaagcattataacca

SEQ ID NO: 941 - DNA, 16 bp, synthetic construct
  misc_feature 1..16: note = Description of sequence: CMP ID NO: 156_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA adenine nucleoside
  modified_base 14: mod_base = OTHER; note = beta-D-oxy-LNA adenine nucleoside
  modified_base 15: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acttactaggcagaag

SEQ ID NO: 942 - DNA, 16 bp, synthetic construct
  misc_feature 1..16: note = Description of sequence: CMP ID NO: 157_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA adenine nucleoside
  modified_base 4: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cagagttaactgtaca

SEQ ID NO: 943 - DNA, 16 bp, synthetic construct
  misc_feature 1..16: note = Description of sequence: CMP ID NO: 158_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ccagagttaactgtac

SEQ ID NO: 944 - DNA, 16 bp, synthetic construct
  misc_feature 1..16: note = Description of sequence: CMP ID NO: 159_1
  source 1..16: mol_type = other DNA
  misc_feature 1..2: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gccagagttaactgta

SEQ ID NO: 945 - DNA, 16 bp, synthetic construct
  misc_feature 1..16: note = Description of sequence: CMP ID NO: 160_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgggccagagttaact

SEQ ID NO: 946 - DNA, 16 bp, synthetic construct
  misc_feature 1..16: note = Description of sequence: CMP ID NO: 161_1
  source 1..16: mol_type = other DNA
  misc_feature 1..2: note = Backbone sugar is not deoxyribose
  misc_feature 15..16: note = Backbone sugar is not deoxyribose
  modified_base 16: mod_base = OTHER; note = beta-D-oxy-LNA thymine nucleoside
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cagcatctatcagact

SEQ ID NO: 947 - DNA, 18 bp, synthetic construct
  misc_feature 1..18: note = Description of sequence: CMP ID NO: 162_1
  source 1..18: mol_type = other DNA
  misc_feature 1..3: note = Backbone sugar is not deoxyribose
  misc_feature 15..18: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 18: mod_base = OTHER; note = beta-D-oxy-LNA thymine nucleoside
  modified_base 3: mod_base = OTHER; note = beta-D-oxy-LNA adenine nucleoside
  modified_base 17: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tgaaataacatgagtcat

SEQ ID NO: 948 - DNA, 17 bp, synthetic construct
  misc_feature 1..17: note = Description of sequence: CMP ID NO: 163_1
  source 1..17: mol_type = other DNA
  misc_feature 1..3: note = Backbone sugar is not deoxyribose
  misc_feature 14..17: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 14: mod_base = OTHER; note = beta-D-oxy-LNA adenine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
gtgaaataacatgagtc

SEQ ID NO: 949 - DNA, 16 bp, synthetic construct
  misc_feature 1..16: note = Description of sequence: CMP ID NO: 164_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tctgtttatgtcactg

SEQ ID NO: 950 - DNA, 16 bp, synthetic construct
  misc_feature 1..16: note = Description of sequence: CMP ID NO: 165_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 4: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtctgtttatgtcact

SEQ ID NO: 951 - DNA, 16 bp, synthetic construct
  misc_feature 1..16: note = Description of sequence: CMP ID NO: 166_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tggtctgtttatgtca

SEQ ID NO: 952 - DNA, 16 bp, synthetic construct
  misc_feature 1..16: note = Description of sequence: CMP ID NO: 167_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttggtctgtttatgtc

SEQ ID NO: 953 - DNA, 16 bp, synthetic construct
  misc_feature 1..16: note = Description of sequence: CMP ID NO: 168_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcacccattgtttaaa

SEQ ID NO: 954 - DNA, 16 bp, synthetic construct
  misc_feature 1..16: note = Description of sequence: CMP ID NO: 169_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 13: mod_base = OTHER; note = beta-D-oxy-LNA thymine nucleoside
  modified_base 16: mod_base = OTHER; note = beta-D-oxy-LNA thymine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttcagcaaatattcgt

SEQ ID NO: 955 - DNA, 17 bp, synthetic construct
  misc_feature 1..17: note = Description of sequence: CMP ID NO: 170_1
  source 1..17: mol_type = other DNA
  misc_feature 1..3: note = Backbone sugar is not deoxyribose
  misc_feature 14..17: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 17: mod_base = OTHER; note = beta-D-oxy-LNA thymine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
gtgtgttcagcaaatat

SEQ ID NO: 956 - DNA, 16 bp, synthetic construct
  misc_feature 1..16: note = Description of sequence: CMP ID NO: 171_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA thymine nucleoside
  modified_base 14: mod_base = OTHER; note = beta-D-oxy-LNA adenine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tctattgttaggtatc

SEQ ID NO: 957 - DNA, 16 bp, synthetic construct
  misc_feature 1..16: note = Description of sequence: CMP ID NO: 172_1
  source 1..16: mol_type = other DNA
  misc_feature 1..2: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
attgcccatcttactg

SEQ ID NO: 958 - DNA, 16 bp, synthetic construct
  misc_feature 1..16: note = Description of sequence: CMP ID NO: 173_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tattgcccatcttact

SEQ ID NO: 959 - DNA, 16 bp, synthetic construct
  misc_feature 1..16: note = Description of sequence: CMP ID NO: 174_1
  source 1..16: mol_type = other DNA
  misc_feature 1..2: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aaatattgcccatctt

SEQ ID NO: 960 - DNA, 16 bp, synthetic construct
  misc_feature 1..16: note = Description of sequence: CMP ID NO: 175_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ataaccttatcataca

SEQ ID NO: 961 - DNA, 16 bp, synthetic construct
  misc_feature 1..16: note = Description of sequence: CMP ID NO: 176_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tataaccttatcatac

SEQ ID NO: 962 - DNA, 16 bp, synthetic construct
  misc_feature 1..16: note = Description of sequence: CMP ID NO: 177_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA thymine nucleoside
  modified_base 3: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttataaccttatcata

SEQ ID NO: 963 - DNA, 16 bp, synthetic construct
  misc_feature 1..16: note = Description of sequence: CMP ID NO: 178_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA thymine nucleoside
  modified_base 16: mod_base = OTHER; note = beta-D-oxy-LNA thymine nucleoside
  modified_base 15: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tttataaccttatcat

SEQ ID NO: 964 - DNA, 16 bp, synthetic construct
  misc_feature 1..16: note = Description of sequence: CMP ID NO: 179_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
actgctattgctatct

SEQ ID NO: 965 - DNA, 16 bp, synthetic construct
  misc_feature 1..16: note = Description of sequence: CMP ID NO: 180_1
  source 1..16: mol_type = other DNA
  misc_feature 1..2: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aggactgctattgcta

SEQ ID NO: 966 - DNA, 16 bp, synthetic construct
  misc_feature 1..16: note = Description of sequence: CMP ID NO: 181_1
  source 1..16: mol_type = other DNA
  misc_feature 1..3: note = Backbone sugar is not deoxyribose
  misc_feature 15..16: note = Backbone sugar is not deoxyribose
  modified_base 16: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gaggactgctattgct

SEQ ID NO: 967 - DNA, 16 bp, synthetic construct
  misc_feature 1..16: note = Description of sequence: CMP ID NO: 182_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acgtagaataataaca

SEQ ID NO: 968 - DNA, 16 bp, synthetic construct
  misc_feature 1..16: note = Description of sequence: CMP ID NO: 183_1
  source 1..16: mol_type = other DNA
  misc_feature 1..2: note = Backbone sugar is not deoxyribose
  misc_feature 13..16: note = Backbone sugar is not deoxyribose
  modified_base 14: mod_base = OTHER; note = beta-D-oxy-LNA thymine nucleoside
  modified_base 13: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ccaagtgatataatgg

SEQ ID NO: 969 - DNA, 16 bp, synthetic construct
  misc_feature 1..16: note = Description of sequence: CMP ID NO: 184_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttagcagaccaagtga

SEQ ID NO: 970 - DNA, 16 bp, synthetic construct
  misc_feature 1..16: note = Description of sequence: CMP ID NO: 185_1
  source 1..16: mol_type = other DNA
  misc_feature 1..2: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtttagcagaccaagt

SEQ ID NO: 971 - DNA, 16 bp, synthetic construct
  misc_feature 1..16: note = Description of sequence: CMP ID NO: 186_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgacagtgattatatt

SEQ ID NO: 972 - DNA, 16 bp, synthetic construct
  misc_feature 1..16: note = Description of sequence: CMP ID NO: 187_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA adenine nucleoside
  modified_base 4: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgtccaagatattgac

SEQ ID NO: 973 - DNA, 16 bp, synthetic construct
  misc_feature 1..16: note = Description of sequence: CMP ID NO: 188_1
  source 1..16: mol_type = other DNA
  misc_feature 1..3: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gaatatcctagattgt

SEQ ID NO: 974 - DNA, 16 bp, synthetic construct
  misc_feature 1..16: note = Description of sequence: CMP ID NO: 189_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
caaactgagaatatcc

SEQ ID NO: 975 - DNA, 16 bp, synthetic construct
  misc_feature 1..16: note = Description of sequence: CMP ID NO: 190_1
  source 1..16: mol_type = other DNA
  misc_feature 1..3: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 3: mod_base = OTHER; note = beta-D-oxy-LNA adenine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcaaactgagaatatc

SEQ ID NO: 976 - DNA, 16 bp, synthetic construct
  misc_feature 1..16: note = Description of sequence: CMP ID NO: 191_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcctattacaatcgta

SEQ ID NO: 977 - DNA, 16 bp, synthetic construct
  misc_feature 1..16: note = Description of sequence: CMP ID NO: 192_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttcctattacaatcgt

SEQ ID NO: 978 - DNA, 16 bp, synthetic construct
  misc_feature 1..16: note = Description of sequence: CMP ID NO: 193_1
  source 1..16: mol_type = other DNA
  misc_feature 1..2: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
actaatgggaggattt

SEQ ID NO: 979 - DNA, 16 bp, synthetic construct
  misc_feature 1..16: note = Description of sequence: CMP ID NO: 194_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tagttcagagaataag

SEQ ID NO: 980 - DNA, 16 bp, synthetic construct
  misc_feature 1..16: note = Description of sequence: CMP ID NO: 195_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA adenine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
taacatatagttcaga

SEQ ID NO: 981 - DNA, 16 bp, synthetic construct
  misc_feature 1..16: note = Description of sequence: CMP ID NO: 196_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ataacatatagttcag

SEQ ID NO: 982 - DNA, 16 bp, synthetic construct
  misc_feature 1..16: note = Description of sequence: CMP ID NO: 197_1
  source 1..16: mol_type = other DNA
  misc_feature 1..2: note = Backbone sugar is not deoxyribose
  misc_feature 15..16: note = Backbone sugar is not deoxyribose
  modified_base 2: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cataacatatagttca

SEQ ID NO: 983 - DNA, 16 bp, synthetic construct
  misc_feature 1..16: note = Description of sequence: CMP ID NO: 198_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcataacatatagttc

SEQ ID NO: 984 - DNA, 16 bp, synthetic construct
  misc_feature 1..16: note = Description of sequence: CMP ID NO: 199_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 4: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tagctcctaacaatca

SEQ ID NO: 985 - DNA, 16 bp, synthetic construct
  misc_feature 1..16: note = Description of sequence: CMP ID NO: 200_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctccaatctttgtata

SEQ ID NO: 986 - DNA, 16 bp, synthetic construct
  misc_feature 1..16: note = Description of sequence: CMP ID NO: 201_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 16: mod_base = OTHER; note = beta-D-oxy-LNA thymine nucleoside
  modified_base 15: mod_base = OTHER; note = beta-D-oxy-LNA adenine nucleoside
  modified_base 2: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tctccaatctttgtat

SEQ ID NO: 987 - DNA, 16 bp, synthetic construct
  misc_feature 1..16: note = Description of sequence: CMP ID NO: 202_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tctatttcagccaatc

SEQ ID NO: 988 - DNA, 16 bp, synthetic construct
  misc_feature 1..16: note = Description of sequence: CMP ID NO: 203_1
  source 1..16: mol_type = other DNA
  misc_feature 1..3: note = Backbone sugar is not deoxyribose
  misc_feature 14..16: note = Backbone sugar is not deoxyribose
  modified_base 15: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cggaagtcagagtgaa

SEQ ID NO: 989 - DNA, 16 bp, synthetic construct
  misc_feature 1..16: note = Description of sequence: CMP ID NO: 204_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA thymine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttaagcatgaggaata

SEQ ID NO: 990 - DNA, 16 bp, synthetic construct
  misc_feature 1..16: note = Description of sequence: CMP ID NO: 205_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgattgagcacctctt

SEQ ID NO: 991 - DNA, 16 bp, synthetic construct
  misc_feature 1..16: note = Description of sequence: CMP ID NO: 206_1
  source 1..16: mol_type = other DNA
  misc_feature 1..3: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gactaattatttcgtt

SEQ ID NO: 992 - DNA, 16 bp, synthetic construct
  misc_feature 1..16: note = Description of sequence: CMP ID NO: 207_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgactaattatttcgt

SEQ ID NO: 993 - DNA, 16 bp, synthetic construct
  misc_feature 1..16: note = Description of sequence: CMP ID NO: 208_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtgactaattatttcg

SEQ ID NO: 994 - DNA, 16 bp, synthetic construct
  misc_feature 1..16: note = Description of sequence: CMP ID NO: 209_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctgcttgaaatgtgac

SEQ ID NO: 995 - DNA, 16 bp, synthetic construct
  misc_feature 1..16: note = Description of sequence: CMP ID NO: 210_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cctgcttgaaatgtga

SEQ ID NO: 996 - DNA, 16 bp, synthetic construct
  misc_feature 1..16: note = Description of sequence: CMP ID NO: 211_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 13: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atcctgcttgaaatgt

SEQ ID NO: 997 - DNA, 16 bp, synthetic construct
  misc_feature 1..16: note = Description of sequence: CMP ID NO: 212_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
attataaatctattct

SEQ ID NO: 998 - DNA, 16 bp, synthetic construct
  misc_feature 1..16: note = Description of sequence: CMP ID NO: 213_1
  source 1..16: mol_type = other DNA
  misc_feature 1..2: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 14: mod_base = OTHER; note = beta-D-oxy-LNA adenine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gctaaatactttcatc

SEQ ID NO: 999 - DNA, 16 bp, synthetic construct
  misc_feature 1..16: note = Description of sequence: CMP ID NO: 214_1
  source 1..16: mol_type = other DNA
  misc_feature 1..2: note = Backbone sugar is not deoxyribose
  misc_feature 13..16: note = Backbone sugar is not deoxyribose
  modified_base 15: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 13: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cattgtaacataccta

SEQ ID NO: 1000 - DNA, 16 bp, synthetic construct
  misc_feature 1..16: note = Description of sequence: CMP ID NO: 215_1
  source 1..16: mol_type = other DNA
  misc_feature 1..2: note = Backbone sugar is not deoxyribose
  misc_feature 15..16: note = Backbone sugar is not deoxyribose
  modified_base 16: mod_base = OTHER; note = beta-D-oxy-LNA thymine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcattgtaacatacct

SEQ ID NO: 1001 - DNA, 16 bp, synthetic construct
  misc_feature 1..16: note = Description of sequence: CMP ID NO: 216_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
taatattgcaccaaat

SEQ ID NO: 1002 - DNA, 16 bp, synthetic construct
  misc_feature 1..16: note = Description of sequence: CMP ID NO: 217_1
  source 1..16: mol_type = other DNA
  misc_feature 1..2: note = Backbone sugar is not deoxyribose
  misc_feature 14..16: note = Backbone sugar is not deoxyribose
  modified_base 2: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gataatattgcaccaa

SEQ ID NO: 1003 - DNA, 16 bp, synthetic construct
  misc_feature 1..16: note = Description of sequence: CMP ID NO: 218_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA adenine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agataatattgcacca

SEQ ID NO: 1004 - DNA, 16 bp, synthetic construct
  misc_feature 1..16: note = Description of sequence: CMP ID NO: 219_1
  source 1..16: mol_type = other DNA
  misc_feature 1..2: note = Backbone sugar is not deoxyribose
  misc_feature 13..16: note = Backbone sugar is not deoxyribose
  modified_base 14: mod_base = OTHER; note = beta-D-oxy-LNA thymine nucleoside
  modified_base 16: mod_base = OTHER; note = beta-D-oxy-LNA thymine nucleoside
  modified_base 13: mod_base = OTHER; note = beta-D-oxy-LNA adenine nucleoside
  modified_base 15: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gccaagaagataatat

SEQ ID NO: 1005 - DNA, 16 bp, synthetic construct
  misc_feature 1..16: note = Description of sequence: CMP ID NO: 220_1
  source 1..16: mol_type = other DNA
  misc_feature 1..4: note = Backbone sugar is not deoxyribose
  misc_feature 15..16: note = Backbone sugar is not deoxyribose
  modified_base 16: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 1: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cacagccacataaact

SEQ ID NO: 1006 - DNA, 16 bp, synthetic construct
  misc_feature 1..16: note = Description of sequence: CMP ID NO: 221_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttgtaattgtggaaac

SEQ ID NO: 1007 - DNA, 16 bp, synthetic construct
  misc_feature 1..16: note = Description of sequence: CMP ID NO: 222_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgacttgtaattgtgg

SEQ ID NO: 1008 - DNA, 16 bp, synthetic construct
  misc_feature 1..16: note = Description of sequence: CMP ID NO: 223_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tctaactgaaatagtc

SEQ ID NO: 1009 - DNA, 16 bp, synthetic construct
  misc_feature 1..16: note = Description of sequence: CMP ID NO: 224_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtggttctaactgaaa

SEQ ID NO: 1010 - DNA, 16 bp, synthetic construct
  misc_feature 1..16: note = Description of sequence: CMP ID NO: 225_1
  source 1..16: mol_type = other DNA
  misc_feature 1..2: note = Backbone sugar is not deoxyribose
  misc_feature 15..16: note = Backbone sugar is not deoxyribose
  modified_base 16: mod_base = OTHER; note = beta-D-oxy-LNA thymine nucleoside
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
caatatgggacttggt

SEQ ID NO: 1011 - DNA, 16 bp, synthetic construct
  misc_feature 1..16: note = Description of sequence: CMP ID NO: 226_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atgacaatatgggact

SEQ ID NO: 1012 - DNA, 16 bp, synthetic construct
  misc_feature 1..16: note = Description of sequence: CMP ID NO: 227_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tatgacaatatgggac

SEQ ID NO: 1013 - DNA, 16 bp, synthetic construct
  misc_feature 1..16: note = Description of sequence: CMP ID NO: 228_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 4: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atatgacaatatggga

SEQ ID NO: 1014 - DNA, 16 bp, synthetic construct
  misc_feature 1..16: note = Description of sequence: CMP ID NO: 229_1
  source 1..16: mol_type = other DNA
  misc_feature 1..2: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cttcacttaataatta

SEQ ID NO: 1015 - DNA, 16 bp, synthetic construct
  misc_feature 1..16: note = Description of sequence: CMP ID NO: 230_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctgcttcacttaataa

SEQ ID NO: 1016 - DNA, 16 bp, synthetic construct
  misc_feature 1..16: note = Description of sequence: CMP ID NO: 231_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aagactgcttcactta

SEQ ID NO: 1017 - DNA, 16 bp, synthetic construct
  misc_feature 1..16: note = Description of sequence: CMP ID NO: 232_1
  source 1..16: mol_type = other DNA
  misc_feature 1..4: note = Backbone sugar is not deoxyribose
  misc_feature 15..16: note = Backbone sugar is not deoxyribose
  modified_base 4: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gaatgccctaattatg

SEQ ID NO: 1018 - DNA, 16 bp, synthetic construct
  misc_feature 1..16: note = Description of sequence: CMP ID NO: 233_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tggaatgccctaatta

SEQ ID NO: 1019 - DNA, 16 bp, synthetic construct
  misc_feature 1..16: note = Description of sequence: CMP ID NO: 234_1
  source 1..16: mol_type = other DNA
  misc_feature 1..3: note = Backbone sugar is not deoxyribose
  misc_feature 15..16: note = Backbone sugar is not deoxyribose
  modified_base 16: mod_base = OTHER; note = beta-D-oxy-LNA thymine nucleoside
  modified_base 3: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcaaatgccagtaggt

SEQ ID NO: 1020 - DNA, 16 bp, synthetic construct
  misc_feature 1..16: note = Description of sequence: CMP ID NO: 235_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 3: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctaatggaaggatttg

SEQ ID NO: 1021 - DNA, 16 bp, synthetic construct
  misc_feature 1..16: note = Description of sequence: CMP ID NO: 236_1
  source 1..16: mol_type = other DNA
  misc_feature 1..2: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aatatagaacctaatg

SEQ ID NO: 1022 - DNA, 16 bp, synthetic construct
  misc_feature 1..16: note = Description of sequence: CMP ID NO: 237_1
  source 1..16: mol_type = other DNA
  misc_feature 1..3: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gaaagaatagaatgtt

SEQ ID NO: 1023 - DNA, 16 bp, synthetic construct
  misc_feature 1..16: note = Description of sequence: CMP ID NO: 238_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atgggtaatagattat

SEQ ID NO: 1024 - DNA, 16 bp, synthetic construct
  misc_feature 1..16: note = Description of sequence: CMP ID NO: 239_1
  source 1..16: mol_type = other DNA
  misc_feature 1..2: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 2: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gaaagagcacagggtg

SEQ ID NO: 1025 - DNA, 16 bp, synthetic construct
  misc_feature 1..16: note = Description of sequence: CMP ID NO: 240_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 3: mod_base = OTHER; note = beta-D-oxy-LNA adenine nucleoside
  modified_base 1: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctacatagagggaatg

SEQ ID NO: 1026 - DNA, 16 bp, synthetic construct
  misc_feature 1..16: note = Description of sequence: CMP ID NO: 241_1
  source 1..16: mol_type = other DNA
  misc_feature 1..2: note = Backbone sugar is not deoxyribose
  misc_feature 13..16: note = Backbone sugar is not deoxyribose
  modified_base 14: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcttcctacatagagg

SEQ ID NO: 1027 - DNA, 16 bp, synthetic construct
  misc_feature 1..16: note = Description of sequence: CMP ID NO: 242_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 4: mod_base = OTHER; note = beta-D-oxy-LNA thymine nucleoside
  modified_base 15: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgcttcctacatagag

SEQ ID NO: 1028 - DNA, 16 bp, synthetic construct
  misc_feature 1..16: note = Description of sequence: CMP ID NO: 243_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA thymine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgggcttgaaatatgt

SEQ ID NO: 1029 - DNA, 16 bp, synthetic construct
  misc_feature 1..16: note = Description of sequence: CMP ID NO: 244_1
  source 1..16: mol_type = other DNA
  misc_feature 1..3: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cattatatttaagaac

SEQ ID NO: 1030 - DNA, 16 bp, synthetic construct
  misc_feature 1..16: note = Description of sequence: CMP ID NO: 245_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 13: mod_base = OTHER; note = beta-D-oxy-LNA thymine nucleoside
  modified_base 16: mod_base = OTHER; note = beta-D-oxy-LNA thymine nucleoside
  modified_base 15: mod_base = OTHER; note = beta-D-oxy-LNA adenine nucleoside
  modified_base 2: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcggttatgttatcat

SEQ ID NO: 1031 - DNA, 16 bp, synthetic construct
  misc_feature 1..16: note = Description of sequence: CMP ID NO: 246_1
  source 1..16: mol_type = other DNA
  misc_feature 1..2: note = Backbone sugar is not deoxyribose
  misc_feature 13..16: note = Backbone sugar is not deoxyribose
  modified_base 13: mod_base = OTHER; note = beta-D-oxy-LNA thymine nucleoside
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cactttatctggtcgg

SEQ ID NO: 1032 - DNA, 16 bp, synthetic construct
  misc_feature 1..16: note = Description of sequence: CMP ID NO: 247_1
  source 1..16: mol_type = other DNA
  misc_feature 1..3: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aaattggcacagcgtt

SEQ ID NO: 1033 - DNA, 16 bp, synthetic construct
  misc_feature 1..16: note = Description of sequence: CMP ID NO: 248_1
  source 1..16: mol_type = other DNA
  misc_feature 1..4: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 14: mod_base = OTHER; note = beta-D-oxy-LNA adenine nucleoside
  modified_base 2: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
accgtgacagtaaatg

SEQ ID NO: 1034 - DNA, 17 bp, synthetic construct
  misc_feature 1..17: note = Description of sequence: CMP ID NO: 249_1
  source 1..17: mol_type = other DNA
  misc_feature 1..2: note = Backbone sugar is not deoxyribose
  misc_feature 16..17: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 17: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tgggaaccgtgacagta

SEQ ID NO: 1035 - DNA, 16 bp, synthetic construct
  misc_feature 1..16: note = Description of sequence: CMP ID NO: 250_1
  source 1..16: mol_type = other DNA
  misc_feature 1..2: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ccacatataggtcctt

SEQ ID NO: 1036 - DNA, 16 bp, synthetic construct
  misc_feature 1..16: note = Description of sequence: CMP ID NO: 251_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
catattgctaccatac

SEQ ID NO: 1037 - DNA, 16 bp, synthetic construct
  misc_feature 1..16: note = Description of sequence: CMP ID NO: 252_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 3: mod_base = OTHER; note = beta-D-oxy-LNA adenine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcatattgctaccata

SEQ ID NO: 1038 - DNA, 16 bp, synthetic construct
  misc_feature 1..16: note = Description of sequence: CMP ID NO: 253_1
  source 1..16: mol_type = other DNA
  misc_feature 1..4: note = Backbone sugar is not deoxyribose
  misc_feature 13..16: note = Backbone sugar is not deoxyribose
  modified_base 4: mod_base = OTHER; note = beta-D-oxy-LNA thymine nucleoside
  modified_base 13: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 1: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
caattgtcatattgct

SEQ ID NO: 1039 - DNA, 18 bp, synthetic construct
  misc_feature 1..18: note = Description of sequence: CMP ID NO: 254_1
  source 1..18: mol_type = other DNA
  misc_feature 1..3: note = Backbone sugar is not deoxyribose
  misc_feature 16..18: note = Backbone sugar is not deoxyribose
  modified_base 3: mod_base = OTHER; note = beta-D-oxy-LNA thymine nucleoside
  modified_base 16: mod_base = OTHER; note = beta-D-oxy-LNA thymine nucleoside
  modified_base 17: mod_base = OTHER; note = beta-D-oxy-LNA thymine nucleoside
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
cattcaattgtcatattg

SEQ ID NO: 1040 - DNA, 17 bp, synthetic construct
  misc_feature 1..17: note = Description of sequence: CMP ID NO: 255_1
  source 1..17: mol_type = other DNA
  misc_feature 1..4: note = Backbone sugar is not deoxyribose
  misc_feature 14..17: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tttctactgggaatttg

SEQ ID NO: 1041 - DNA, 16 bp, synthetic construct
  misc_feature 1..16: note = Description of sequence: CMP ID NO: 256_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA adenine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
caattagtgcagccag

SEQ ID NO: 1042 - DNA, 17 bp, synthetic construct
  misc_feature 1..17: note = Description of sequence: CMP ID NO: 257_1
  source 1..17: mol_type = other DNA
  misc_feature 1..4: note = Backbone sugar is not deoxyribose
  misc_feature 15..17: note = Backbone sugar is not deoxyribose
  modified_base 4: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 16: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
gaataatgttcttatcc

SEQ ID NO: 1043 - DNA, 20 bp, synthetic construct
  misc_feature 1..20: note = Description of sequence: CMP ID NO: 258_1
  source 1..20: mol_type = other DNA
  misc_feature 1..4: note = Backbone sugar is not deoxyribose
  misc_feature 18..20: note = Backbone sugar is not deoxyribose
  modified_base 18: mod_base = OTHER; note = beta-D-oxy-LNA thymine nucleoside
  modified_base 20: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 1: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 19: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
cacaaattgaataatgttct

SEQ ID NO: 1044 - DNA, 19 bp, synthetic construct
  misc_feature 1..19: note = Description of sequence: CMP ID NO: 259_1
  source 1..19: mol_type = other DNA
  misc_feature 1..4: note = Backbone sugar is not deoxyribose
  misc_feature 16..19: note = Backbone sugar is not deoxyribose
  modified_base 3: mod_base = OTHER; note = beta-D-oxy-LNA thymine nucleoside
  modified_base 16: mod_base = OTHER; note = beta-D-oxy-LNA thymine nucleoside
  modified_base 19: mod_base = OTHER; note = beta-D-oxy-LNA thymine nucleoside
  modified_base 2: mod_base = OTHER; note = beta-D-oxy-LNA adenine nucleoside
  modified_base 17: mod_base = OTHER; note = beta-D-oxy-LNA adenine nucleoside
  modified_base 18: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
catgcacaaattgaataat

SEQ ID NO: 1045 - DNA, 17 bp, synthetic construct
  misc_feature 1..17: note = Description of sequence: CMP ID NO: 260_1
  source 1..17: mol_type = other DNA
  misc_feature 1..3: note = Backbone sugar is not deoxyribose
  misc_feature 15..17: note = Backbone sugar is not deoxyribose
  modified_base 2: mod_base = OTHER; note = beta-D-oxy-LNA thymine nucleoside
  modified_base 17: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  modified_base 3: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
atcctgcaatttcacat

SEQ ID NO: 1046 - DNA, 16 bp, synthetic construct
  misc_feature 1..16: note = Description of sequence: CMP ID NO: 261_1
  source 1..16: mol_type = other DNA
  misc_feature 1..2: note = Backbone sugar is not deoxyribose
  misc_feature 15..16: note = Backbone sugar is not deoxyribose
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ccaccatagctgatca

SEQ ID NO: 1047 - DNA, 17 bp, synthetic construct
  misc_feature 1..17: note = Description of sequence: CMP ID NO: 262_1
  source 1..17: mol_type = other DNA
  misc_feature 1..2: note = Backbone sugar is not deoxyribose
  misc_feature 15..17: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 17: mod_base = OTHER; note = beta-D-oxy-LNA adenine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
accaccatagctgatca

SEQ ID NO: 1048 - DNA, 17 bp, synthetic construct
  misc_feature 1..17: note = Description of sequence: CMP ID NO: 263_1
  source 1..17: mol_type = other DNA
  misc_feature 1..2: note = Backbone sugar is not deoxyribose
  misc_feature 16..17: note = Backbone sugar is not deoxyribose
  modified_base 16: mod_base = OTHER; note = beta-D-oxy-LNA thymine nucleoside
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
caccaccatagctgatc

SEQ ID NO: 1049 - DNA, 16 bp, synthetic construct
  misc_feature 1..16: note = Description of sequence: CMP ID NO: 264_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tagtcggcaccaccat

SEQ ID NO: 1050 - DNA, 17 bp, synthetic construct
  misc_feature 1..17: note = Description of sequence: CMP ID NO: 265_1
  source 1..17: mol_type = other DNA
  misc_feature 1: note = Backbone sugar is not deoxyribose
  misc_feature 16..17: note = Backbone sugar is not deoxyribose
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
cttgtagtcggcaccac

SEQ ID NO: 1051 - DNA, 16 bp, synthetic construct
  misc_feature 1..16: note = Description of sequence: CMP ID NO: 266_1
  source 1..16: mol_type = other DNA
  misc_feature 1: note = Backbone sugar is not deoxyribose
  misc_feature 15..16: note = Backbone sugar is not deoxyribose
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cttgtagtcggcacca

SEQ ID NO: 1052 - DNA, 16 bp, synthetic construct
  misc_feature 1..16: note = Description of sequence: CMP ID NO: 267_1
  source 1..16: mol_type = other DNA
  misc_feature 1..2: note = Backbone sugar is not deoxyribose
  misc_feature 15..16: note = Backbone sugar is not deoxyribose
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cgcttgtagtcggcac

SEQ ID NO: 1053 - DNA, 16 bp, synthetic construct
  misc_feature 1..16: note = Description of sequence: CMP ID NO: 268_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA adenine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcaataaagatcaggc

SEQ ID NO: 1054 - DNA, 16 bp, synthetic construct
  misc_feature 1..16: note = Description of sequence: CMP ID NO: 269_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tggacttacaagaatg

SEQ ID NO: 1055 - DNA, 16 bp, synthetic construct
  misc_feature 1..16: note = Description of sequence: CMP ID NO: 270_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atggacttacaagaat

SEQ ID NO: 1056 - DNA, 16 bp, synthetic construct
  misc_feature 1..16: note = Description of sequence: CMP ID NO: 271_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 16: mod_base = OTHER; note = beta-D-oxy-LNA thymine nucleoside
  modified_base 15: mod_base = OTHER; note = beta-D-oxy-LNA adenine nucleoside
  modified_base 2: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gctcaagaaattggat

SEQ ID NO: 1057 - DNA, 16 bp, synthetic construct
  misc_feature 1..16: note = Description of sequence: CMP ID NO: 272_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 4: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tactgtagaacatggc

SEQ ID NO: 1058 - DNA, 16 bp, synthetic construct
  misc_feature 1..16: note = Description of sequence: CMP ID NO: 273_1
  source 1..16: mol_type = other DNA
  misc_feature 1..4: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcaattcatttgatct

SEQ ID NO: 1059 - DNA, 18 bp, synthetic construct
  misc_feature 1..18: note = Description of sequence: CMP ID NO: 274_1
  source 1..18: mol_type = other DNA
  misc_feature 1..2: note = Backbone sugar is not deoxyribose
  misc_feature 17..18: note = Backbone sugar is not deoxyribose
  modified_base 1: mod_base = OTHER; note = beta-D-oxy-LNA thymine nucleoside
  modified_base 17: mod_base = OTHER; note = beta-D-oxy-LNA adenine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tgaagggaggagggacac

SEQ ID NO: 1060 - DNA, 17 bp, synthetic construct
  misc_feature 1..17: note = Description of sequence: CMP ID NO: 275_1
  source 1..17: mol_type = other DNA
  misc_feature 1..2: note = Backbone sugar is not deoxyribose
  misc_feature 16..17: note = Backbone sugar is not deoxyribose
  modified_base 1: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
agtggtgaagggaggag

SEQ ID NO: 1061 - DNA, 18 bp, synthetic construct
  misc_feature 1..18: note = Description of sequence: CMP ID NO: 276_1
  source 1..18: mol_type = other DNA
  misc_feature 1..2: note = Backbone sugar is not deoxyribose
  misc_feature 17..18: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA adenine nucleoside
  modified_base 17: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tagtggtgaagggaggag

SEQ ID NO: 1062 - DNA, 19 bp, synthetic construct
  misc_feature 1..19: note = Description of sequence: CMP ID NO: 277_1
  source 1..19: mol_type = other DNA
  misc_feature 1: note = Backbone sugar is not deoxyribose
  misc_feature 18..19: note = Backbone sugar is not deoxyribose
  modified_base 1: mod_base = OTHER; note = beta-D-oxy-LNA adenine nucleoside
  modified_base 18: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
atagtggtgaagggaggag

SEQ ID NO: 1063 - DNA, 17 bp, synthetic construct
  misc_feature 1..17: note = Description of sequence: CMP ID NO: 278_1
  source 1..17: mol_type = other DNA
  misc_feature 1..2: note = Backbone sugar is not deoxyribose
  misc_feature 16..17: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA adenine nucleoside
  modified_base 17: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tagtggtgaagggagga

SEQ ID NO: 1064 - DNA, 18 bp, synthetic construct
  misc_feature 1..18: note = Description of sequence: CMP ID NO: 279_1
  source 1..18: mol_type = other DNA
  misc_feature 1..2: note = Backbone sugar is not deoxyribose
  misc_feature 17..18: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 18: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
atagtggtgaagggagga

SEQ ID NO: 1065 - DNA, 16 bp, synthetic construct
  misc_feature 1..16: note = Description of sequence: CMP ID NO: 280_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tagtggtgaagggagg

SEQ ID NO: 1066 - DNA, 17 bp, synthetic construct
  misc_feature 1..17: note = Description of sequence: CMP ID NO: 281_1
  source 1..17: mol_type = other DNA
  misc_feature 1..3: note = Backbone sugar is not deoxyribose
  misc_feature 16..17: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
atagtggtgaagggagg

SEQ ID NO: 1067 - DNA, 18 bp, synthetic construct
  misc_feature 1..18: note = Description of sequence: CMP ID NO: 282_1
  source 1..18: mol_type = other DNA
  misc_feature 1..2: note = Backbone sugar is not deoxyribose
  misc_feature 17..18: note = Backbone sugar is not deoxyribose
  modified_base 2: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
gatagtggtgaagggagg

SEQ ID NO: 1068 - DNA, 16 bp, synthetic construct
  misc_feature 1..16: note = Description of sequence: CMP ID NO: 283_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atagtggtgaagggag

SEQ ID NO: 1069 - DNA, 17 bp, synthetic construct
  misc_feature 1..17: note = Description of sequence: CMP ID NO: 284_1
  source 1..17: mol_type = other DNA
  misc_feature 1..2: note = Backbone sugar is not deoxyribose
  misc_feature 15..17: note = Backbone sugar is not deoxyribose
  modified_base 2: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
gatagtggtgaagggag

SEQ ID NO: 1070 - DNA, 16 bp, synthetic construct
  misc_feature 1..16: note = Description of sequence: CMP ID NO: 285_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA adenine nucleoside
  modified_base 13: mod_base = OTHER; note = beta-D-oxy-LNA adenine nucleoside
  modified_base 14: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gagatagtggtgaagg

SEQ ID NO: 1071 - DNA, 16 bp, synthetic construct
  misc_feature 1..16: note = Description of sequence: CMP ID NO: 286_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
catgggagatagtggt

SEQ ID NO: 1072 - DNA, 18 bp, synthetic construct
  misc_feature 1..18: note = Description of sequence: CMP ID NO: 287_1
  source 1..18: mol_type = other DNA
  misc_feature 1..4: note = Backbone sugar is not deoxyribose
  misc_feature 15..18: note = Backbone sugar is not deoxyribose
  modified_base 16: mod_base = OTHER; note = beta-D-oxy-LNA thymine nucleoside
  modified_base 18: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
acaaataatggttactct

SEQ ID NO: 1073 - DNA, 18 bp, synthetic construct
  misc_feature 1..18: note = Description of sequence: CMP ID NO: 288_1
  source 1..18: mol_type = other DNA
  misc_feature 1..4: note = Backbone sugar is not deoxyribose
  misc_feature 15..18: note = Backbone sugar is not deoxyribose
  modified_base 16: mod_base = OTHER; note = beta-D-oxy-LNA thymine nucleoside
  modified_base 17: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 18: mod_base = OTHER; note = beta-D-oxy-LNA adenine nucleoside
  modified_base 2: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
acacacaaataatggtta

SEQ ID NO: 1074 - DNA, 18 bp, synthetic construct
  misc_feature 1..18: note = Description of sequence: CMP ID NO: 289_1
  source 1..18: mol_type = other DNA
  misc_feature 1..3: note = Backbone sugar is not deoxyribose
  misc_feature 15..18: note = Backbone sugar is not deoxyribose
  modified_base 15: mod_base = OTHER; note = beta-D-oxy-LNA thymine nucleoside
  modified_base 18: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 17: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
gagggacacacaaataat

SEQ ID NO: 1075 - DNA, 16 bp, synthetic construct
  misc_feature 1..16: note = Description of sequence: CMP ID NO: 290_1
  source 1..16: mol_type = other DNA
  misc_feature 1..4: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 4: mod_base = OTHER; note = beta-D-oxy-LNA thymine nucleoside
  modified_base 13: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atatagagaggctcaa

SEQ ID NO: 1076 - DNA, 16 bp, synthetic construct
  misc_feature 1..16: note = Description of sequence: CMP ID NO: 291_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 16: mod_base = OTHER; note = beta-D-oxy-LNA thymine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttgatatagagaggct

SEQ ID NO: 1077 - DNA, 16 bp, synthetic construct
  misc_feature 1..16: note = Description of sequence: CMP ID NO: 292_1
  source 1..16: mol_type = other DNA
  misc_feature 1..4: note = Backbone sugar is not deoxyribose
  misc_feature 14..16: note = Backbone sugar is not deoxyribose
  modified_base 4: mod_base = OTHER; note = beta-D-oxy-LNA thymine nucleoside
  modified_base 3: mod_base = OTHER; note = beta-D-oxy-LNA adenine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcatttgatatagaga

SEQ ID NO: 1078 - DNA, 16 bp, synthetic construct
  misc_feature 1..16: note = Description of sequence: CMP ID NO: 293_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tttgcatttgatatag

SEQ ID NO: 1079 - DNA, 16 bp, synthetic construct
  misc_feature 1..16: note = Description of sequence: CMP ID NO: 294_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctggaagaataggttc

SEQ ID NO: 1080 - DNA, 16 bp, synthetic construct
  misc_feature 1..16: note = Description of sequence: CMP ID NO: 295_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
actggaagaataggtt

SEQ ID NO: 1081 - DNA, 16 bp, synthetic construct
  misc_feature 1..16: note = Description of sequence: CMP ID NO: 296_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 4: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tactggaagaataggt

SEQ ID NO: 1082 - DNA, 16 bp, synthetic construct
  misc_feature 1..16: note = Description of sequence: CMP ID NO: 297_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 4: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tggcttatcctgtact

SEQ ID NO: 1083 - DNA, 16 bp, synthetic construct
  misc_feature 1..16: note = Description of sequence: CMP ID NO: 298_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atggcttatcctgtac

SEQ ID NO: 1084 - DNA, 16 bp, synthetic construct
  misc_feature 1..16: note = Description of sequence: CMP ID NO: 299_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tatggcttatcctgta

SEQ ID NO: 1085 - DNA, 16 bp, synthetic construct
  misc_feature 1..16: note = Description of sequence: CMP ID NO: 300_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtatggcttatcctgt

SEQ ID NO: 1086 - DNA, 17 bp, synthetic construct
  misc_feature 1..17: note = Description of sequence: CMP ID NO: 301_1
  source 1..17: mol_type = other DNA
  misc_feature 1..2: note = Backbone sugar is not deoxyribose
  misc_feature 14..17: note = Backbone sugar is not deoxyribose
  modified_base 2: mod_base = OTHER; note = beta-D-oxy-LNA thymine nucleoside
  modified_base 17: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
atgaatatatgcccagt

SEQ ID NO: 1087 - DNA, 16 bp, synthetic construct
  misc_feature 1..16: note = Description of sequence: CMP ID NO: 302_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA adenine nucleoside
  modified_base 16: mod_base = OTHER; note = beta-D-oxy-LNA adenine nucleoside
  modified_base 13: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gatgaatatatgccca

SEQ ID NO: 1088 - DNA, 17 bp, synthetic construct
  misc_feature 1..17: note = Description of sequence: CMP ID NO: 303_1
  source 1..17: mol_type = other DNA
  misc_feature 1..3: note = Backbone sugar is not deoxyribose
  misc_feature 14..17: note = Backbone sugar is not deoxyribose
  modified_base 14: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
caagatgaatatatgcc

SEQ ID NO: 1089 - DNA, 17 bp, synthetic construct
  misc_feature 1..17: note = Description of sequence: CMP ID NO: 304_1
  source 1..17: mol_type = other DNA
  misc_feature 1..4: note = Backbone sugar is not deoxyribose
  misc_feature 14..17: note = Backbone sugar is not deoxyribose
  modified_base 14: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 17: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
gacaacatcagtataga

SEQ ID NO: 1090 - DNA, 16 bp, synthetic construct
  misc_feature 1..16: note = Description of sequence: CMP ID NO: 305_1
  source 1..16: mol_type = other DNA
  misc_feature 1..4: note = Backbone sugar is not deoxyribose
  misc_feature 13..16: note = Backbone sugar is not deoxyribose
  modified_base 15: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 13: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
caagacaacatcagta

SEQ ID NO: 1091 - DNA, 16 bp, synthetic construct
  misc_feature 1..16: note = Description of sequence: CMP ID NO: 306_1
  source 1..16: mol_type = other DNA
  misc_feature 1..3: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cactcctagttccttt

SEQ ID NO: 1092 - DNA, 16 bp, synthetic construct
  misc_feature 1..16: note = Description of sequence: CMP ID NO: 307_1
  source 1..16: mol_type = other DNA
  misc_feature 1..3: note = Backbone sugar is not deoxyribose
  misc_feature 14..16: note = Backbone sugar is not deoxyribose
  modified_base 16: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 3: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aacactcctagttcct

SEQ ID NO: 1093 - DNA, 16 bp, synthetic construct
  misc_feature 1..16: note = Description of sequence: CMP ID NO: 308_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
taacactcctagttcc

SEQ ID NO: 1094 - DNA, 16 bp, synthetic construct
  misc_feature 1..16: note = Description of sequence: CMP ID NO: 309_1
  source 1..16: mol_type = other DNA
  misc_feature 1..2: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctaacactcctagttc

SEQ ID NO: 1095 - DNA, 16 bp, synthetic construct
  misc_feature 1..16: note = Description of sequence: CMP ID NO: 310_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgataacataactgtg

SEQ ID NO: 1096 - DNA, 16 bp, synthetic construct
  misc_feature 1..16: note = Description of sequence: CMP ID NO: 311_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA 5-methyl cytosine nucleoside
  modified_base 13: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctgataacataactgt

SEQ ID NO: 1097 - DNA, 16 bp, synthetic construct
  misc_feature 1..16: note = Description of sequence: CMP ID NO: 312_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tttgaactcaagtgac

SEQ ID NO: 1098 - DNA, 16 bp, synthetic construct
  misc_feature 1..16: note = Description of sequence: CMP ID NO: 313_1
  source 1..16: mol_type = other DNA
  misc_feature 1..4: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 4: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA adenine nucleoside
  modified_base 2: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcctttacttagctag

SEQ ID NO: 1099 - DNA, 16 bp, synthetic construct
  misc_feature 1..16: note = Description of sequence: CMP ID NO: 314_1
  source 1..16: mol_type = other DNA
  misc_feature 1..2: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 2: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gagtttggattagctg

SEQ ID NO: 1100 - DNA, 16 bp, synthetic construct
  misc_feature 1..16: note = Description of sequence: CMP ID NO: 315_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgggatatgacaggga

SEQ ID NO: 1101 - DNA, 16 bp, synthetic construct
  misc_feature 1..16: note = Description of sequence: CMP ID NO: 316_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgtgggatatgacagg

SEQ ID NO: 1102 - DNA, 16 bp, synthetic construct
  misc_feature 1..16: note = Description of sequence: CMP ID NO: 317_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 4: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atatggaagggatatc

SEQ ID NO: 1103 - DNA, 16 bp, synthetic construct
  misc_feature 1..16: note = Description of sequence: CMP ID NO: 318_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA adenine nucleoside
  modified_base 3: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acaggatatggaaggg

SEQ ID NO: 1104 - DNA, 17 bp, synthetic construct
  misc_feature 1..17: note = Description of sequence: CMP ID NO: 319_1
  source 1..17: mol_type = other DNA
  misc_feature 1..4: note = Backbone sugar is not deoxyribose
  misc_feature 14..17: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 4: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA adenine nucleoside
  modified_base 14: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
atttcaacaggatatgg

SEQ ID NO: 1105 - DNA, 16 bp, synthetic construct
  misc_feature 1..16: note = Description of sequence: CMP ID NO: 320_1
  source 1..16: mol_type = other DNA
  misc_feature 1..2: note = Backbone sugar is not deoxyribose
  misc_feature 14..16: note = Backbone sugar is not deoxyribose
  modified_base 2: mod_base = OTHER; note = beta-D-oxy-LNA adenine nucleoside
  modified_base 14: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gagtaatttcaacagg

SEQ ID NO: 1106 - DNA, 17 bp, synthetic construct
  misc_feature 1..17: note = Description of sequence: CMP ID NO: 321_1
  source 1..17: mol_type = other DNA
  misc_feature 1..4: note = Backbone sugar is not deoxyribose
  misc_feature 14..17: note = Backbone sugar is not deoxyribose
  modified_base 1: mod_base = OTHER; note = beta-D-oxy-LNA adenine nucleoside
  modified_base 14: mod_base = OTHER; note = beta-D-oxy-LNA adenine nucleoside
  modified_base 15: mod_base = OTHER; note = beta-D-oxy-LNA adenine nucleoside
  modified_base 17: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
agggagtaatttcaaca

SEQ ID NO: 1107 - DNA, 17 bp, synthetic construct
  misc_feature 1..17: note = Description of sequence: CMP ID NO: 322_1
  source 1..17: mol_type = other DNA
  misc_feature 1..4: note = Backbone sugar is not deoxyribose
  misc_feature 14..17: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA adenine nucleoside
  modified_base 4: mod_base = OTHER; note = beta-D-oxy-LNA adenine nucleoside
  modified_base 17: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
attagggagtaatttca

SEQ ID NO: 1108 - DNA, 16 bp, synthetic construct
  misc_feature 1..16: note = Description of sequence: CMP ID NO: 323_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 14: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cttactattagggagt

SEQ ID NO: 1109 - DNA, 16 bp, synthetic construct
  misc_feature 1..16: note = Description of sequence: CMP ID NO: 324_1
  source 1..16: mol_type = other DNA
  misc_feature 1..2: note = Backbone sugar is not deoxyribose
  misc_feature 14..16: note = Backbone sugar is not deoxyribose
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cagcttactattaggg

SEQ ID NO: 1110 - DNA, 18 bp, synthetic construct
  misc_feature 1..18: note = Description of sequence: CMP ID NO: 326_1
  source 1..18: mol_type = other DNA
  misc_feature 1..3: note = Backbone sugar is not deoxyribose
  misc_feature 15..18: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 17: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
atttcagcttactattag

SEQ ID NO: 1111 - DNA, 16 bp, synthetic construct
  misc_feature 1..16: note = Description of sequence: CMP ID NO: 325_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA adenine nucleoside
  modified_base 14: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcagcttactattagg

SEQ ID NO: 1112 - DNA, 16 bp, synthetic construct
  misc_feature 1..16: note = Description of sequence: CMP ID NO: 327_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 13: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttcagcttactattag

SEQ ID NO: 1113 - DNA, 16 bp, synthetic construct
  misc_feature 1..16: note = Description of sequence: CMP ID NO: 328_1
  source 1..16: mol_type = other DNA
  misc_feature 1..4: note = Backbone sugar is not deoxyribose
  misc_feature 15..16: note = Backbone sugar is not deoxyribose
  modified_base 16: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 1: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cagatttcagcttact

SEQ ID NO: 1114 - DNA, 16 bp, synthetic construct
  misc_feature 1..16: note = Description of sequence: CMP ID NO: 329_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gactacaactagaggg

SEQ ID NO: 1115 - DNA, 16 bp, synthetic construct
  misc_feature 1..16: note = Description of sequence: CMP ID NO: 330_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA adenine nucleoside
  modified_base 3: mod_base = OTHER; note = beta-D-oxy-LNA adenine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agactacaactagagg

SEQ ID NO: 1116 - DNA, 16 bp, synthetic construct
  misc_feature 1..16: note = Description of sequence: CMP ID NO: 331_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA adenine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aagactacaactagag

SEQ ID NO: 1117 - DNA, 20 bp, synthetic construct
  misc_feature 1..20: note = Description of sequence: CMP ID NO: 332_1
  source 1..20: mol_type = other DNA
  misc_feature 1..4: note = Backbone sugar is not deoxyribose
  misc_feature 17..20: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 4: mod_base = OTHER; note = beta-D-oxy-LNA adenine nucleoside
  modified_base 18: mod_base = OTHER; note = beta-D-oxy-LNA adenine nucleoside
  modified_base 19: mod_base = OTHER; note = beta-D-oxy-LNA adenine nucleoside
  modified_base 20: mod_base = OTHER; note = beta-D-oxy-LNA adenine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
atgatttaattctagtcaaa

SEQ ID NO: 1118 - DNA, 16 bp, synthetic construct
  misc_feature 1..16: note = Description of sequence: CMP ID NO: 333_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA thymine nucleoside
  modified_base 14: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tttaattctagtcaaa

SEQ ID NO: 1119 - DNA, 16 bp, synthetic construct
  misc_feature 1..16: note = Description of sequence: CMP ID NO: 334_1
  source 1..16: mol_type = other DNA
  misc_feature 1..4: note = Backbone sugar is not deoxyribose
  misc_feature 13..16: note = Backbone sugar is not deoxyribose
  modified_base 3: mod_base = OTHER; note = beta-D-oxy-LNA thymine nucleoside
  modified_base 4: mod_base = OTHER; note = beta-D-oxy-LNA thymine nucleoside
  modified_base 14: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gatttaattctagtca

SEQ ID NO: 1120 - DNA, 17 bp, synthetic construct
  misc_feature 1..17: note = Description of sequence: CMP ID NO: 771_1
  source 1..17: mol_type = other DNA
  misc_feature 1..3: note = Backbone sugar is not deoxyribose
  misc_feature 14..17: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 3: mod_base = OTHER; note = beta-D-oxy-LNA adenine nucleoside
  modified_base 17: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tgatttaattctagtca

SEQ ID NO: 1121 - DNA, 18 bp, synthetic construct
  misc_feature 1..18: note = Description of sequence: CMP ID NO: 335_1
  source 1..18: mol_type = other DNA
  misc_feature 1..4: note = Backbone sugar is not deoxyribose
  misc_feature 16..18: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 4: mod_base = OTHER; note = beta-D-oxy-LNA adenine nucleoside
  modified_base 18: mod_base = OTHER; note = beta-D-oxy-LNA adenine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
atgatttaattctagtca

SEQ ID NO: 1122 - DNA, 19 bp, synthetic construct
  misc_feature 1..19: note = Description of sequence: CMP ID NO: 336_1
  source 1..19: mol_type = other DNA
  misc_feature 1..4: note = Backbone sugar is not deoxyribose
  misc_feature 18..19: note = Backbone sugar is not deoxyribose
  modified_base 3: mod_base = OTHER; note = beta-D-oxy-LNA thymine nucleoside
  modified_base 2: mod_base = OTHER; note = beta-D-oxy-LNA adenine nucleoside
  modified_base 19: mod_base = OTHER; note = beta-D-oxy-LNA adenine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
gatgatttaattctagtca

SEQ ID NO: 1123 - DNA, 16 bp, synthetic construct
  misc_feature 1..16: note = Description of sequence: CMP ID NO: 337_1
  source 1..16: mol_type = other DNA
  misc_feature 1..2: note = Backbone sugar is not deoxyribose
  misc_feature 13..16: note = Backbone sugar is not deoxyribose
  modified_base 14: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gatttaattctagtca

SEQ ID NO: 1124 - DNA, 18 bp, synthetic construct
  misc_feature 1..18: note = Description of sequence: CMP ID NO: 338_1
  source 1..18: mol_type = other DNA
  misc_feature 1..4: note = Backbone sugar is not deoxyribose
  misc_feature 16..18: note = Backbone sugar is not deoxyribose
  modified_base 3: mod_base = OTHER; note = beta-D-oxy-LNA thymine nucleoside
  modified_base 17: mod_base = OTHER; note = beta-D-oxy-LNA thymine nucleoside
  modified_base 2: mod_base = OTHER; note = beta-D-oxy-LNA adenine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
gatgatttaattctagtc

SEQ ID NO: 1125 - DNA, 16 bp, synthetic construct
  misc_feature 1..16: note = Description of sequence: CMP ID NO: 339_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgatttaattctagtc

SEQ ID NO: 1126 - DNA, 17 bp, synthetic construct
  misc_feature 1..17: note = Description of sequence: CMP ID NO: 340_1
  source 1..17: mol_type = other DNA
  misc_feature 1..4: note = Backbone sugar is not deoxyribose
  misc_feature 14..17: note = Backbone sugar is not deoxyribose
  modified_base 14: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 17: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
gagatgatttaattcta

SEQ ID NO: 1127 - DNA, 16 bp, synthetic construct
  misc_feature 1..16: note = Description of sequence: CMP ID NO: 341_1
  source 1..16: mol_type = other DNA
  misc_feature 1..3: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gagatgatttaattct

SEQ ID NO: 1128 - DNA, 16 bp, synthetic construct
  misc_feature 1..16: note = Description of sequence: CMP ID NO: 342_1
  source 1..16: mol_type = other DNA
  misc_feature 1..4: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cagattgatggtagtt

SEQ ID NO: 1129 - DNA, 16 bp, synthetic construct
  misc_feature 1..16: note = Description of sequence: CMP ID NO: 343_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctcagattgatggtag

SEQ ID NO: 1130 - DNA, 16 bp, synthetic construct
  misc_feature 1..16: note = Description of sequence: CMP ID NO: 344_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA thymine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gttagccctcagattg

SEQ ID NO: 1131 - DNA, 16 bp, synthetic construct
  misc_feature 1..16: note = Description of sequence: CMP ID NO: 345_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 13: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgtattgttagccctc

SEQ ID NO: 1132 - DNA, 16 bp, synthetic construct
  misc_feature 1..16: note = Description of sequence: CMP ID NO: 346_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA adenine nucleoside
  modified_base 13: mod_base = OTHER; note = beta-D-oxy-LNA adenine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acttgtattgttagcc

SEQ ID NO: 1133 - DNA, 16 bp, synthetic construct
  misc_feature 1..16: note = Description of sequence: CMP ID NO: 347_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA adenine nucleoside
  modified_base 15: mod_base = OTHER; note = beta-D-oxy-LNA adenine nucleoside
  modified_base 3: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agccagtatcagggac

SEQ ID NO: 1134 - DNA, 16 bp, synthetic construct
  misc_feature 1..16: note = Description of sequence: CMP ID NO: 348_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 16: mod_base = OTHER; note = beta-D-oxy-LNA thymine nucleoside
  modified_base 15: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttgacaatagtggcat

SEQ ID NO: 1135 - DNA, 16 bp, synthetic construct
  misc_feature 1..16: note = Description of sequence: CMP ID NO: 349_1
  source 1..16: mol_type = other DNA
  misc_feature 1..3: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acaagtggtatcttct

SEQ ID NO: 1136 - DNA, 16 bp, synthetic construct
  misc_feature 1..16: note = Description of sequence: CMP ID NO: 350_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aatctactttacaagt

SEQ ID NO: 1137 - DNA, 18 bp, synthetic construct
  misc_feature 1..18: note = Description of sequence: CMP ID NO: 351_1
  source 1..18: mol_type = other DNA
  misc_feature 1..2: note = Backbone sugar is not deoxyribose
  misc_feature 15..18: note = Backbone sugar is not deoxyribose
  modified_base 17: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 18: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
cacagtagatgcctgata

SEQ ID NO: 1138 - DNA, 16 bp, synthetic construct
  misc_feature 1..16: note = Description of sequence: CMP ID NO: 352_1
  source 1..16: mol_type = other DNA
  misc_feature 1..2: note = Backbone sugar is not deoxyribose
  misc_feature 14..16: note = Backbone sugar is not deoxyribose
  modified_base 2: mod_base = OTHER; note = beta-D-oxy-LNA adenine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gaacacagtagatgcc

SEQ ID NO: 1139 - DNA, 17 bp, synthetic construct
  misc_feature 1..17: note = Description of sequence: CMP ID NO: 353_1
  source 1..17: mol_type = other DNA
  misc_feature 1..4: note = Backbone sugar is not deoxyribose
  misc_feature 16..17: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 17: mod_base = OTHER; note = beta-D-oxy-LNA thymine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
cttggaacacagtagat

SEQ ID NO: 1140 - DNA, 16 bp, synthetic construct
  misc_feature 1..16: note = Description of sequence: CMP ID NO: 354_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atatcttggaacacag

SEQ ID NO: 1141 - DNA, 18 bp, synthetic construct
  misc_feature 1..18: note = Description of sequence: CMP ID NO: 355_1
  source 1..18: mol_type = other DNA
  misc_feature 1..3: note = Backbone sugar is not deoxyribose
  misc_feature 15..18: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 16: mod_base = OTHER; note = beta-D-oxy-LNA adenine nucleoside
  modified_base 17: mod_base = OTHER; note = beta-D-oxy-LNA adenine nucleoside
  modified_base 2: mod_base = OTHER; note = beta-D-oxy-LNA 5-methyl cytosine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tctttaatatcttggaac

SEQ ID NO: 1142 - DNA, 19 bp, synthetic construct
  misc_feature 1..19: note = Description of sequence: CMP ID NO: 356_1
  source 1..19: mol_type = other DNA
  misc_feature 1..2: note = Backbone sugar is not deoxyribose
  misc_feature 16..19: note = Backbone sugar is not deoxyribose
  modified_base 1: mod_base = OTHER; note = beta-D-oxy-LNA thymine nucleoside
  modified_base 17: mod_base = OTHER; note = beta-D-oxy-LNA thymine nucleoside
  modified_base 18: mod_base = OTHER; note = beta-D-oxy-LNA thymine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
tgatttctttaatatcttg

SEQ ID NO: 1143 - DNA, 19 bp, synthetic construct
  misc_feature 1..19: note = Description of sequence: CMP ID NO: 357_1
  source 1..19: mol_type = other DNA
  misc_feature 1..2: note = Backbone sugar is not deoxyribose
  misc_feature 16..19: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 18: mod_base = OTHER; note = beta-D-oxy-LNA thymine nucleoside
  modified_base 17: mod_base = OTHER; note = beta-D-oxy-LNA adenine nucleoside
  modified_base 19: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
tgatgatttctttaatatc

SEQ ID NO: 1144 - DNA, 16 bp, synthetic construct
  misc_feature 1..16: note = Description of sequence: CMP ID NO: 358_1
  source 1..16: mol_type = other DNA
  misc_feature 1..3: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aggctaagtcatgatg

SEQ ID NO: 1145 - DNA, 16 bp, synthetic construct
  misc_feature 1..16: note = Description of sequence: CMP ID NO: 359_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA thymine nucleoside
  modified_base 4: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttgatgaggctaagtc

SEQ ID NO: 1146 - DNA, 16 bp, synthetic construct
  misc_feature 1..16: note = Description of sequence: CMP ID NO: 360_1
  source 1..16: mol_type = other DNA
  misc_feature 1..3: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ccaggattatactctt

SEQ ID NO: 1147 - DNA, 16 bp, synthetic construct
  misc_feature 1..16: note = Description of sequence: CMP ID NO: 361_1
  source 1..16: mol_type = other DNA
  misc_feature 1..2: note = Backbone sugar is not deoxyribose
  misc_feature 13..16: note = Backbone sugar is not deoxyribose
  modified_base 14: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA 5-methyl cytosine nucleoside
  modified_base 13: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gccaggattatactct

SEQ ID NO: 1148 - DNA, 16 bp, synthetic construct
  misc_feature 1..16: note = Description of sequence: CMP ID NO: 362_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctgccaggattatact

SEQ ID NO: 1149 - DNA, 19 bp, synthetic construct
  misc_feature 1..19: note = Description of sequence: CMP ID NO: 363_1
  source 1..19: mol_type = other DNA
  misc_feature 1..4: note = Backbone sugar is not deoxyribose
  misc_feature 18..19: note = Backbone sugar is not deoxyribose
  modified_base 18: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
cagaaacttatactttatg

SEQ ID NO: 1150 - DNA, 17 bp, synthetic construct
  misc_feature 1..17: note = Description of sequence: CMP ID NO: 364_1
  source 1..17: mol_type = other DNA
  misc_feature 1..4: note = Backbone sugar is not deoxyribose
  misc_feature 14..17: note = Backbone sugar is not deoxyribose
  modified_base 14: mod_base = OTHER; note = beta-D-oxy-LNA thymine nucleoside
  modified_base 17: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 4: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
aagcagaaacttatact

SEQ ID NO: 1151 - DNA, 18 bp, synthetic construct
  misc_feature 1..18: note = Description of sequence: CMP ID NO: 365_1
  source 1..18: mol_type = other DNA
  misc_feature 1..3: note = Backbone sugar is not deoxyribose
  misc_feature 15..18: note = Backbone sugar is not deoxyribose
  modified_base 15: mod_base = OTHER; note = beta-D-oxy-LNA thymine nucleoside
  modified_base 18: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 16: mod_base = OTHER; note = beta-D-oxy-LNA adenine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
gaagcagaaacttatact

SEQ ID NO: 1152 - DNA, 20 bp, synthetic construct
  misc_feature 1..20: note = Description of sequence: CMP ID NO: 366_1
  source 1..20: mol_type = other DNA
  misc_feature 1..3: note = Backbone sugar is not deoxyribose
  misc_feature 19..20: note = Backbone sugar is not deoxyribose
  modified_base 1: mod_base = OTHER; note = beta-D-oxy-LNA thymine nucleoside
  modified_base 20: mod_base = OTHER; note = beta-D-oxy-LNA thymine nucleoside
  modified_base 19: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
tggaagcagaaacttatact

SEQ ID NO: 1153 - DNA, 19 bp, synthetic construct
  misc_feature 1..19: note = Description of sequence: CMP ID NO: 367_1
  source 1..19: mol_type = other DNA
  misc_feature 1..3: note = Backbone sugar is not deoxyribose
  misc_feature 17..19: note = Backbone sugar is not deoxyribose
  modified_base 1: mod_base = OTHER; note = beta-D-oxy-LNA thymine nucleoside
  modified_base 17: mod_base = OTHER; note = beta-D-oxy-LNA thymine nucleoside
  modified_base 18: mod_base = OTHER; note = beta-D-oxy-LNA adenine nucleoside
  modified_base 19: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
tggaagcagaaacttatac

SEQ ID NO: 1154 - DNA, 16 bp, synthetic construct
  misc_feature 1..16: note = Description of sequence: CMP ID NO: 368_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aagcagaaacttatac

SEQ ID NO: 1155 - DNA, 18 bp, synthetic construct
  misc_feature 1..18: note = Description of sequence: CMP ID NO: 369_1
  source 1..18: mol_type = other DNA
  misc_feature 1..3: note = Backbone sugar is not deoxyribose
  misc_feature 15..18: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 17: mod_base = OTHER; note = beta-D-oxy-LNA thymine nucleoside
  modified_base 16: mod_base = OTHER; note = beta-D-oxy-LNA adenine nucleoside
  modified_base 18: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tggaagcagaaacttata

SEQ ID NO: 1156 - DNA, 16 bp, synthetic construct
  misc_feature 1..16: note = Description of sequence: CMP ID NO: 370_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA adenine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aagggatattatggag

SEQ ID NO: 1157 - DNA, 16 bp, synthetic construct
  misc_feature 1..16: note = Description of sequence: CMP ID NO: 371_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgccggaagatttcct

SEQ ID NO: 1158 - DNA, 16 bp, synthetic construct
  misc_feature 1..16: note = Description of sequence: CMP ID NO: 372_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atggattgggagtaga

SEQ ID NO: 1159 - DNA, 16 bp, synthetic construct
  misc_feature 1..16: note = Description of sequence: CMP ID NO: 373_1
  source 1..16: mol_type = other DNA
  misc_feature 1..2: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agatggattgggagta

SEQ ID NO: 1160 - DNA, 16 bp, synthetic construct
  misc_feature 1..16: note = Description of sequence: CMP ID NO: 374_1
  source 1..16: mol_type = other DNA
  misc_feature 1..3: note = Backbone sugar is not deoxyribose
  misc_feature 15..16: note = Backbone sugar is not deoxyribose
  modified_base 16: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aagatggattgggagt

SEQ ID NO: 1161 - DNA, 16 bp, synthetic construct
  misc_feature 1..16: note = Description of sequence: CMP ID NO: 375_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acaagatggattggga

SEQ ID NO: 1162 - DNA, 16 bp, synthetic construct
  misc_feature 1..16: note = Description of sequence: CMP ID NO: 375_2
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acaagatggattggga

SEQ ID NO: 1163 - DNA, 16 bp, synthetic construct
  misc_feature 1..16: note = Description of sequence: CMP ID NO: 376_1
  source 1..16: mol_type = other DNA
  misc_feature 1..3: note = Backbone sugar is not deoxyribose
  misc_feature 13..16: note = Backbone sugar is not deoxyribose
  modified_base 14: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 13: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agaaggttcagacttt

SEQ ID NO: 1164 - DNA, 16 bp, synthetic construct
  misc_feature 1..16: note = Description of sequence: CMP ID NO: 377_1
  source 1..16: mol_type = other DNA
  misc_feature 1..2: note = Backbone sugar is not deoxyribose
  misc_feature 14..16: note = Backbone sugar is not deoxyribose
  modified_base 16: mod_base = OTHER; note = beta-D-oxy-LNA thymine nucleoside
  modified_base 14: mod_base = OTHER; note = beta-D-oxy-LNA adenine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcagaaggttcagact

SEQ ID NO: 1165 - DNA, 16 bp, synthetic construct
  misc_feature 1..16: note = Description of sequence: CMP ID NO: 377_2
  source 1..16: mol_type = other DNA
  misc_feature 1..3: note = Backbone sugar is not deoxyribose
  misc_feature 15..16: note = Backbone sugar is not deoxyribose
  modified_base 16: mod_base = OTHER; note = beta-D-oxy-LNA thymine nucleoside
  modified_base 3: mod_base = OTHER; note = beta-D-oxy-LNA adenine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcagaaggttcagact

SEQ ID NO: 1166 - DNA, 16 bp, synthetic construct
  misc_feature 1..16: note = Description of sequence: CMP ID NO: 378_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 3: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgcagaaggttcagac

SEQ ID NO: 1167 - DNA, 16 bp, synthetic construct
  misc_feature 1..16: note = Description of sequence: CMP ID NO: 379_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA adenine nucleoside
  modified_base 15: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agtgcagaaggttcag

SEQ ID NO: 1168 - DNA, 16 bp, synthetic construct
  misc_feature 1..16: note = Description of sequence: CMP ID NO: 379_2
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agtgcagaaggttcag

SEQ ID NO: 1169 - DNA, 16 bp, synthetic construct
  misc_feature 1..16: note = Description of sequence: CMP ID NO: 380_1
  source 1..16: mol_type = other DNA
  misc_feature 1..4: note = Backbone sugar is not deoxyribose
  misc_feature 15..16: note = Backbone sugar is not deoxyribose
  modified_base 4: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aagtgcagaaggttca

SEQ ID NO: 1170 - DNA, 16 bp, synthetic construct
  misc_feature 1..16: note = Description of sequence: CMP ID NO: 381_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
taagtgcagaaggttc

SEQ ID NO: 1171 - DNA, 16 bp, synthetic construct
  misc_feature 1..16: note = Description of sequence: CMP ID NO: 382_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 13: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tctaagtgcagaaggt

SEQ ID NO: 1172 - DNA, 17 bp, synthetic construct
  misc_feature 1..17: note = Description of sequence: CMP ID NO: 383_1
  source 1..17: mol_type = other DNA
  misc_feature 1..3: note = Backbone sugar is not deoxyribose
  misc_feature 16..17: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
ctcaggagttctacttc

SEQ ID NO: 1173 - DNA, 16 bp, synthetic construct
  misc_feature 1..16: note = Description of sequence: CMP ID NO: 384_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctcaggagttctactt

SEQ ID NO: 1174 - DNA, 18 bp, synthetic construct
  misc_feature 1..18: note = Description of sequence: CMP ID NO: 385_1
  source 1..18: mol_type = other DNA
  misc_feature 1: note = Backbone sugar is not deoxyribose
  misc_feature 17..18: note = Backbone sugar is not deoxyribose
  modified_base 1: mod_base = OTHER; note = beta-D-oxy-LNA adenine nucleoside
  modified_base 17: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
atggaggtgactcaggag

SEQ ID NO: 1175 - DNA, 17 bp, synthetic construct
  misc_feature 1..17: note = Description of sequence: CMP ID NO: 386_1
  source 1..17: mol_type = other DNA
  misc_feature 1..2: note = Backbone sugar is not deoxyribose
  misc_feature 16..17: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 17: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
atggaggtgactcagga

SEQ ID NO: 1176 - DNA, 16 bp, synthetic construct
  misc_feature 1..16: note = Description of sequence: CMP ID NO: 387_1
  source 1..16: mol_type = other DNA
  misc_feature 1..2: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 14: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atggaggtgactcagg

SEQ ID NO: 1177 - DNA, 17 bp, synthetic construct
  misc_feature 1..17: note = Description of sequence: CMP ID NO: 388_1
  source 1..17: mol_type = other DNA
  misc_feature 1..2: note = Backbone sugar is not deoxyribose
  misc_feature 15..17: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tatggaggtgactcagg

SEQ ID NO: 1178 - DNA, 18 bp, synthetic construct
  misc_feature 1..18: note = Description of sequence: CMP ID NO: 389_1
  source 1..18: mol_type = other DNA
  misc_feature 1..2: note = Backbone sugar is not deoxyribose
  misc_feature 17..18: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
atatggaggtgactcagg

SEQ ID NO: 1179 - DNA, 16 bp, synthetic construct
  misc_feature 1..16: note = Description of sequence: CMP ID NO: 390_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tatggaggtgactcag

SEQ ID NO: 1180 - DNA, 17 bp, synthetic construct
  misc_feature 1..17: note = Description of sequence: CMP ID NO: 391_1
  source 1..17: mol_type = other DNA
  misc_feature 1..2: note = Backbone sugar is not deoxyribose
  misc_feature 14..17: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
atatggaggtgactcag

SEQ ID NO: 1181 - DNA, 18 bp, synthetic construct
  misc_feature 1..18: note = Description of sequence: CMP ID NO: 392_1
  source 1..18: mol_type = other DNA
  misc_feature 1..2: note = Backbone sugar is not deoxyribose
  misc_feature 17..18: note = Backbone sugar is not deoxyribose
  modified_base 2: mod_base = OTHER; note = beta-D-oxy-LNA adenine nucleoside
  modified_base 17: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
catatggaggtgactcag

SEQ ID NO: 1182 - DNA, 16 bp, synthetic construct
  misc_feature 1..16: note = Description of sequence: CMP ID NO: 393_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atatggaggtgactca

SEQ ID NO: 1183 - DNA, 17 bp, synthetic construct
  misc_feature 1..17: note = Description of sequence: CMP ID NO: 394_1
  source 1..17: mol_type = other DNA
  misc_feature 1..2: note = Backbone sugar is not deoxyribose
  misc_feature 15..17: note = Backbone sugar is not deoxyribose
  modified_base 15: mod_base = OTHER; note = beta-D-oxy-LNA thymine nucleoside
  modified_base 2: mod_base = OTHER; note = beta-D-oxy-LNA adenine nucleoside
  modified_base 17: mod_base = OTHER; note = beta-D-oxy-LNA adenine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
catatggaggtgactca

SEQ ID NO: 1184 - DNA, 16 bp, synthetic construct
  misc_feature 1..16: note = Description of sequence: CMP ID NO: 395_1
  source 1..16: mol_type = other DNA
  misc_feature 1..2: note = Backbone sugar is not deoxyribose
  misc_feature 13..16: note = Backbone sugar is not deoxyribose
  modified_base 15: mod_base = OTHER; note = beta-D-oxy-LNA thymine nucleoside
  modified_base 2: mod_base = OTHER; note = beta-D-oxy-LNA adenine nucleoside
  modified_base 13: mod_base = OTHER; note = beta-D-oxy-LNA adenine nucleoside
  modified_base 1: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
catatggaggtgactc

SEQ ID NO: 1185 - DNA, 17 bp, synthetic construct
  misc_feature 1..17: note = Description of sequence: CMP ID NO: 396_1
  source 1..17: mol_type = other DNA
  misc_feature 1..2: note = Backbone sugar is not deoxyribose
  misc_feature 16..17: note = Backbone sugar is not deoxyribose
  modified_base 16: mod_base = OTHER; note = beta-D-oxy-LNA thymine nucleoside
  modified_base 2: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
gcatatggaggtgactc

SEQ ID NO: 1186 - DNA, 18 bp, synthetic construct
  misc_feature 1..18: note = Description of sequence: CMP ID NO: 397_1
  source 1..18: mol_type = other DNA
  misc_feature 1..2: note = Backbone sugar is not deoxyribose
  misc_feature 17..18: note = Backbone sugar is not deoxyribose
  modified_base 1: mod_base = OTHER; note = beta-D-oxy-LNA thymine nucleoside
  modified_base 17: mod_base = OTHER; note = beta-D-oxy-LNA thymine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tgcatatggaggtgactc

SEQ ID NO: 1187 - DNA, 19 bp, synthetic construct
  misc_feature 1..19: note = Description of sequence: CMP ID NO: 398_1
  source 1..19: mol_type = other DNA
  misc_feature 1: note = Backbone sugar is not deoxyribose
  misc_feature 18..19: note = Backbone sugar is not deoxyribose
  modified_base 1: mod_base = OTHER; note = beta-D-oxy-LNA thymine nucleoside
  modified_base 18: mod_base = OTHER; note = beta-D-oxy-LNA thymine nucleoside
  modified_base 19: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
ttgcatatggaggtgactc

SEQ ID NO: 1188 - DNA, 20 bp, synthetic construct
  misc_feature 1..20: note = Description of sequence: CMP ID NO: 399_1
  source 1..20: mol_type = other DNA
  misc_feature 1: note = Backbone sugar is not deoxyribose
  misc_feature 19..20: note = Backbone sugar is not deoxyribose
  modified_base 1: mod_base = OTHER; note = beta-D-oxy-LNA thymine nucleoside
  modified_base 19: mod_base = OTHER; note = beta-D-oxy-LNA thymine nucleoside
  modified_base 20: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
tttgcatatggaggtgactc

SEQ ID NO: 1189 - DNA, 16 bp, synthetic construct
  misc_feature 1..16: note = Description of sequence: CMP ID NO: 400_1
  source 1..16: mol_type = other DNA
  misc_feature 1..2: note = Backbone sugar is not deoxyribose
  misc_feature 15..16: note = Backbone sugar is not deoxyribose
  modified_base 16: mod_base = OTHER; note = beta-D-oxy-LNA thymine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcatatggaggtgact

SEQ ID NO: 1190 - DNA, 17 bp, synthetic construct
  misc_feature 1..17: note = Description of sequence: CMP ID NO: 401_1
  source 1..17: mol_type = other DNA
  misc_feature 1..2: note = Backbone sugar is not deoxyribose
  misc_feature 16..17: note = Backbone sugar is not deoxyribose
  modified_base 1: mod_base = OTHER; note = beta-D-oxy-LNA thymine nucleoside
  modified_base 17: mod_base = OTHER; note = beta-D-oxy-LNA thymine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tgcatatggaggtgact

SEQ ID NO: 1191 - DNA, 18 bp, synthetic construct
  misc_feature 1..18: note = Description of sequence: CMP ID NO: 402_1
  source 1..18: mol_type = other DNA
  misc_feature 1..3: note = Backbone sugar is not deoxyribose
  misc_feature 17..18: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 18: mod_base = OTHER; note = beta-D-oxy-LNA thymine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
ttgcatatggaggtgact

SEQ ID NO: 1192 - DNA, 19 bp, synthetic construct
  misc_feature 1..19: note = Description of sequence: CMP ID NO: 403_1
  source 1..19: mol_type = other DNA
  misc_feature 1: note = Backbone sugar is not deoxyribose
  misc_feature 18..19: note = Backbone sugar is not deoxyribose
  modified_base 1: mod_base = OTHER; note = beta-D-oxy-LNA thymine nucleoside
  modified_base 19: mod_base = OTHER; note = beta-D-oxy-LNA thymine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
tttgcatatggaggtgact

SEQ ID NO: 1193 - DNA, 16 bp, synthetic construct
  misc_feature 1..16: note = Description of sequence: CMP ID NO: 404_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA adenine nucleoside
  modified_base 3: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgcatatggaggtgac

SEQ ID NO: 1194 - DNA, 17 bp, synthetic construct
  misc_feature 1..17: note = Description of sequence: CMP ID NO: 405_1
  source 1..17: mol_type = other DNA
  misc_feature 1..3: note = Backbone sugar is not deoxyribose
  misc_feature 15..17: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 16: mod_base = OTHER; note = beta-D-oxy-LNA adenine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
ttgcatatggaggtgac

SEQ ID NO: 1195 - DNA, 18 bp, synthetic construct
  misc_feature 1..18: note = Description of sequence: CMP ID NO: 406_1
  source 1..18: mol_type = other DNA
  misc_feature 1..4: note = Backbone sugar is not deoxyribose
  misc_feature 17..18: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA thymine nucleoside
  modified_base 17: mod_base = OTHER; note = beta-D-oxy-LNA adenine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tttgcatatggaggtgac

SEQ ID NO: 1196 - DNA, 17 bp, synthetic construct
  misc_feature 1..17: note = Description of sequence: CMP ID NO: 407_1
  source 1..17: mol_type = other DNA
  misc_feature 1..4: note = Backbone sugar is not deoxyribose
  misc_feature 16..17: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA thymine nucleoside
  modified_base 17: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tttgcatatggaggtga

SEQ ID NO: 1197 - DNA, 16 bp, synthetic construct
  misc_feature 1..16: note = Description of sequence: CMP ID NO: 408_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA thymine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tttgcatatggaggtg

SEQ ID NO: 1198 - DNA, 17 bp, synthetic construct
  misc_feature 1..17: note = Description of sequence: CMP ID NO: 409_1
  source 1..17: mol_type = other DNA
  misc_feature 1..2: note = Backbone sugar is not deoxyribose
  misc_feature 14..17: note = Backbone sugar is not deoxyribose
  modified_base 1: mod_base = OTHER; note = beta-D-oxy-LNA adenine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 14: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
aagtgaagttcaacagc

SEQ ID NO: 1199 - DNA, 16 bp, synthetic construct
  misc_feature 1..16: note = Description of sequence: CMP ID NO: 410_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 13: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgggaagtgaagttca

SEQ ID NO: 1200 - DNA, 16 bp, synthetic construct
  misc_feature 1..16: note = Description of sequence: CMP ID NO: 411_1
  source 1..16: mol_type = other DNA
  misc_feature 1..2: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atgggaagtgaagttc

SEQ ID NO: 1201 - DNA, 16 bp, synthetic construct
  misc_feature 1..16: note = Description of sequence: CMP ID NO: 412_1
  source 1..16: mol_type = other DNA
  misc_feature 1..4: note = Backbone sugar is not deoxyribose
  misc_feature 14..16: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gatgggaagtgaagtt

SEQ ID NO: 1202 - DNA, 17 bp, synthetic construct
  misc_feature 1..17: note = Description of sequence: CMP ID NO: 413_1
  source 1..17: mol_type = other DNA
  misc_feature 1..3: note = Backbone sugar is not deoxyribose
  misc_feature 15..17: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA adenine nucleoside
  modified_base 17: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
ctgtgatgggaagtgaa

SEQ ID NO: 1203 - DNA, 16 bp, synthetic construct
  misc_feature 1..16: note = Description of sequence: CMP ID NO: 414_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 1: mod_base = OTHER; note = beta-D-oxy-LNA adenine nucleoside
  modified_base 14: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
attgagtgaatccaaa

SEQ ID NO: 1204 - DNA, 16 bp, synthetic construct
  misc_feature 1..16: note = Description of sequence: CMP ID NO: 415_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA adenine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 13: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aattgagtgaatccaa

SEQ ID NO: 1205 - DNA, 17 bp, synthetic construct
  misc_feature 1..17: note = Description of sequence: CMP ID NO: 416_1
  source 1..17: mol_type = other DNA
  misc_feature 1..4: note = Backbone sugar is not deoxyribose
  misc_feature 15..17: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 16: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
gataattgagtgaatcc

SEQ ID NO: 1206 - DNA, 16 bp, synthetic construct
  misc_feature 1..16: note = Description of sequence: CMP ID NO: 417_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtgataattgagtgaa

SEQ ID NO: 1207 - DNA, 16 bp, synthetic construct
  misc_feature 1..16: note = Description of sequence: CMP ID NO: 418_1
  source 1..16: mol_type = other DNA
  misc_feature 1..3: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aagaaaggtgcaataa

SEQ ID NO: 1208 - DNA, 16 bp, synthetic construct
  misc_feature 1..16: note = Description of sequence: CMP ID NO: 419_1
  source 1..16: mol_type = other DNA
  misc_feature 1..2: note = Backbone sugar is not deoxyribose
  misc_feature 13..16: note = Backbone sugar is not deoxyribose
  modified_base 15: mod_base = OTHER; note = beta-D-oxy-LNA thymine nucleoside
  modified_base 2: mod_base = OTHER; note = beta-D-oxy-LNA adenine nucleoside
  modified_base 13: mod_base = OTHER; note = beta-D-oxy-LNA adenine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
caagaaaggtgcaata

SEQ ID NO: 1209 - DNA, 16 bp, synthetic construct
  misc_feature 1..16: note = Description of sequence: CMP ID NO: 420_1
  source 1..16: mol_type = other DNA
  misc_feature 1..4: note = Backbone sugar is not deoxyribose
  misc_feature 15..16: note = Backbone sugar is not deoxyribose
  modified_base 16: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acaagaaaggtgcaat

SEQ ID NO: 1210 - DNA, 16 bp, synthetic construct
  misc_feature 1..16: note = Description of sequence: CMP ID NO: 421_1
  source 1..16: mol_type = other DNA
  misc_feature 1..2: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atttaaactcacaaac

SEQ ID NO: 1211 - DNA, 16 bp, synthetic construct
  misc_feature 1..16: note = Description of sequence: CMP ID NO: 422_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctgttaggttcagcga

SEQ ID NO: 1212 - DNA, 17 bp, synthetic construct
  misc_feature 1..17: note = Description of sequence: CMP ID NO: 423_1
  source 1..17: mol_type = other DNA
  misc_feature 1..4: note = Backbone sugar is not deoxyribose
  misc_feature 14..17: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tctgaatgaacatttcg

SEQ ID NO: 1213 - DNA, 16 bp, synthetic construct
  misc_feature 1..16: note = Description of sequence: CMP ID NO: 424_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 13: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctcattgaaggttctg

SEQ ID NO: 1214 - DNA, 16 bp, synthetic construct
  misc_feature 1..16: note = Description of sequence: CMP ID NO: 425_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctaatctcattgaagg

SEQ ID NO: 1215 - DNA, 16 bp, synthetic construct
  misc_feature 1..16: note = Description of sequence: CMP ID NO: 426_1
  source 1..16: mol_type = other DNA
  misc_feature 1..2: note = Backbone sugar is not deoxyribose
  misc_feature 15..16: note = Backbone sugar is not deoxyribose
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cctaatctcattgaag

SEQ ID NO: 1216 - DNA, 16 bp, synthetic construct
  misc_feature 1..16: note = Description of sequence: CMP ID NO: 427_1
  source 1..16: mol_type = other DNA
  misc_feature 1..3: note = Backbone sugar is not deoxyribose
  misc_feature 14..16: note = Backbone sugar is not deoxyribose
  modified_base 3: mod_base = OTHER; note = beta-D-oxy-LNA thymine nucleoside
  modified_base 1: mod_base = OTHER; note = beta-D-oxy-LNA adenine nucleoside
  modified_base 14: mod_base = OTHER; note = beta-D-oxy-LNA adenine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
actttgatctttcagc

SEQ ID NO: 1217 - DNA, 16 bp, synthetic construct
  misc_feature 1..16: note = Description of sequence: CMP ID NO: 428_1
  source 1..16: mol_type = other DNA
  misc_feature 1..2: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
actatgcaacactttg

SEQ ID NO: 1218 - DNA, 16 bp, synthetic construct
  misc_feature 1..16: note = Description of sequence: CMP ID NO: 429_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA adenine nucleoside
  modified_base 3: mod_base = OTHER; note = beta-D-oxy-LNA adenine nucleoside
  modified_base 1: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
caaatagctttatcgg

SEQ ID NO: 1219 - DNA, 16 bp, synthetic construct
  misc_feature 1..16: note = Description of sequence: CMP ID NO: 430_1
  source 1..16: mol_type = other DNA
  misc_feature 1..2: note = Backbone sugar is not deoxyribose
  misc_feature 13..16: note = Backbone sugar is not deoxyribose
  modified_base 14: mod_base = OTHER; note = beta-D-oxy-LNA thymine nucleoside
  modified_base 13: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ccaaatagctttatcg

SEQ ID NO: 1220 - DNA, 16 bp, synthetic construct
  misc_feature 1..16: note = Description of sequence: CMP ID NO: 431_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 4: mod_base = OTHER; note = beta-D-oxy-LNA adenine nucleoside
  modified_base 2: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tccaaatagctttatc

SEQ ID NO: 1221 - DNA, 16 bp, synthetic construct
  misc_feature 1..16: note = Description of sequence: CMP ID NO: 432_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gatccaaatagcttta

SEQ ID NO: 1222 - DNA, 16 bp, synthetic construct
  misc_feature 1..16: note = Description of sequence: CMP ID NO: 433_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atgatccaaatagctt

SEQ ID NO: 1223 - DNA, 16 bp, synthetic construct
  misc_feature 1..16: note = Description of sequence: CMP ID NO: 434_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tatgatccaaatagct

SEQ ID NO: 1224 - DNA, 17 bp, synthetic construct
  misc_feature 1..17: note = Description of sequence: CMP ID NO: 435_1
  source 1..17: mol_type = other DNA
  misc_feature 1..4: note = Backbone sugar is not deoxyribose
  misc_feature 14..17: note = Backbone sugar is not deoxyribose
  modified_base 1: mod_base = OTHER; note = beta-D-oxy-LNA thymine nucleoside
  modified_base 17: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
taaacagggctgggaat

SEQ ID NO: 1225 - DNA, 16 bp, synthetic construct
  misc_feature 1..16: note = Description of sequence: CMP ID NO: 436_1
  source 1..16: mol_type = other DNA
  misc_feature 1..2: note = Backbone sugar is not deoxyribose
  misc_feature 13..16: note = Backbone sugar is not deoxyribose
  modified_base 14: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA 5-methyl cytosine nucleoside
  modified_base 13: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acttaaacagggctgg

SEQ ID NO: 1226 - DNA, 16 bp, synthetic construct
  misc_feature 1..16: note = Description of sequence: CMP ID NO: 437_1
  source 1..16: mol_type = other DNA
  misc_feature 1..2: note = Backbone sugar is not deoxyribose
  misc_feature 13..16: note = Backbone sugar is not deoxyribose
  modified_base 16: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acacttaaacagggct

SEQ ID NO: 1227 - DNA, 16 bp, synthetic construct
  misc_feature 1..16: note = Description of sequence: CMP ID NO: 438_1
  source 1..16: mol_type = other DNA
  misc_feature 1..4: note = Backbone sugar is not deoxyribose
  misc_feature 13..16: note = Backbone sugar is not deoxyribose
  modified_base 2: mod_base = OTHER; note = beta-D-oxy-LNA adenine nucleoside
  modified_base 3: mod_base = OTHER; note = beta-D-oxy-LNA adenine nucleoside
  modified_base 13: mod_base = OTHER; note = beta-D-oxy-LNA adenine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gaacacttaaacaggg

SEQ ID NO: 1228 - DNA, 17 bp, synthetic construct
  misc_feature 1..17: note = Description of sequence: CMP ID NO: 439_1
  source 1..17: mol_type = other DNA
  misc_feature 1..4: note = Backbone sugar is not deoxyribose
  misc_feature 14..17: note = Backbone sugar is not deoxyribose
  modified_base 1: mod_base = OTHER; note = beta-D-oxy-LNA adenine nucleoside
  modified_base 3: mod_base = OTHER; note = beta-D-oxy-LNA adenine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
agagaacacttaaacag

SEQ ID NO: 1229 - DNA, 16 bp, synthetic construct
  misc_feature 1..16: note = Description of sequence: CMP ID NO: 440_1
  source 1..16: mol_type = other DNA
  misc_feature 1..4: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA thymine nucleoside
  modified_base 3: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  modified_base 13: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctacagagaacactta

SEQ ID NO: 1230 - DNA, 17 bp, synthetic construct
  misc_feature 1..17: note = Description of sequence: CMP ID NO: 441_1
  source 1..17: mol_type = other DNA
  misc_feature 1..3: note = Backbone sugar is not deoxyribose
  misc_feature 14..17: note = Backbone sugar is not deoxyribose
  modified_base 2: mod_base = OTHER; note = beta-D-oxy-LNA thymine nucleoside
  modified_base 17: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA adenine nucleoside
  modified_base 14: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
atgctacagagaacact

SEQ ID NO: 1231 - DNA, 19 bp, synthetic construct
  misc_feature 1..19: note = Description of sequence: CMP ID NO: 442_1
  source 1..19: mol_type = other DNA
  misc_feature 1..4: note = Backbone sugar is not deoxyribose
  misc_feature 16..19: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 16: mod_base = OTHER; note = beta-D-oxy-LNA adenine nucleoside
  modified_base 17: mod_base = OTHER; note = beta-D-oxy-LNA adenine nucleoside
  modified_base 19: mod_base = OTHER; note = beta-D-oxy-LNA adenine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
ataaatgctacagagaaca

SEQ ID NO: 1232 - DNA, 18 bp, synthetic construct
  misc_feature 1..18: note = Description of sequence: CMP ID NO: 443_1
  source 1..18: mol_type = other DNA
  misc_feature 1..2: note = Backbone sugar is not deoxyribose
  misc_feature 15..18: note = Backbone sugar is not deoxyribose
  modified_base 1: mod_base = OTHER; note = beta-D-oxy-LNA adenine nucleoside
  modified_base 16: mod_base = OTHER; note = beta-D-oxy-LNA adenine nucleoside
  modified_base 18: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
agataaatgctacagaga

SEQ ID NO: 1233 - DNA, 17 bp, synthetic construct
  misc_feature 1..17: note = Description of sequence: CMP ID NO: 444_1
  source 1..17: mol_type = other DNA
  misc_feature 1..4: note = Backbone sugar is not deoxyribose
  misc_feature 14..17: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 17: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tagagataaatgctaca

SEQ ID NO: 1234 - DNA, 18 bp, synthetic construct
  misc_feature 1..18: note = Description of sequence: CMP ID NO: 445_1
  source 1..18: mol_type = other DNA
  misc_feature 1..4: note = Backbone sugar is not deoxyribose
  misc_feature 16..18: note = Backbone sugar is not deoxyribose
  modified_base 1: mod_base = OTHER; note = beta-D-oxy-LNA thymine nucleoside
  modified_base 18: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tagatagagataaatgct

SEQ ID NO: 1235 - DNA, 18 bp, synthetic construct
  misc_feature 1..18: note = Description of sequence: CMP ID NO: 446_1
  source 1..18: mol_type = other DNA
  misc_feature 1..4: note = Backbone sugar is not deoxyribose
  misc_feature 15..18: note = Backbone sugar is not deoxyribose
  modified_base 4: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 16: mod_base = OTHER; note = beta-D-oxy-LNA adenine nucleoside
  modified_base 18: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
caatatactagatagaga

SEQ ID NO: 1236 - DNA, 19 bp, synthetic construct
  misc_feature 1..19: note = Description of sequence: CMP ID NO: 447_1
  source 1..19: mol_type = other DNA
  misc_feature 1..4: note = Backbone sugar is not deoxyribose
  misc_feature 16..19: note = Backbone sugar is not deoxyribose
  modified_base 1: mod_base = OTHER; note = beta-D-oxy-LNA thymine nucleoside
  modified_base 17: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 16: mod_base = OTHER; note = beta-D-oxy-LNA adenine nucleoside
  modified_base 18: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
tacacaatatactagatag

SEQ ID NO: 1237 - DNA, 16 bp, synthetic construct
  misc_feature 1..16: note = Description of sequence: CMP ID NO: 448_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctacacaatatactag

SEQ ID NO: 1238 - DNA, 16 bp, synthetic construct
  misc_feature 1..16: note = Description of sequence: CMP ID NO: 449_1
  source 1..16: mol_type = other DNA
  misc_feature 1..4: note = Backbone sugar is not deoxyribose
  misc_feature 13..16: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 4: mod_base = OTHER; note = beta-D-oxy-LNA adenine nucleoside
  modified_base 13: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gctacacaatatacta

SEQ ID NO: 1239 - DNA, 18 bp, synthetic construct
  misc_feature 1..18: note = Description of sequence: CMP ID NO: 450_1
  source 1..18: mol_type = other DNA
  misc_feature 1..4: note = Backbone sugar is not deoxyribose
  misc_feature 15..18: note = Backbone sugar is not deoxyribose
  modified_base 2: mod_base = OTHER; note = beta-D-oxy-LNA thymine nucleoside
  modified_base 4: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  modified_base 17: mod_base = OTHER; note = beta-D-oxy-LNA adenine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
atatgctacacaatatac

SEQ ID NO: 1240 - DNA, 16 bp, synthetic construct
  misc_feature 1..16: note = Description of sequence: CMP ID NO: 451_1
  source 1..16: mol_type = other DNA
  misc_feature 1..4: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 4: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 14: mod_base = OTHER; note = beta-D-oxy-LNA adenine nucleoside
  modified_base 15: mod_base = OTHER; note = beta-D-oxy-LNA adenine nucleoside
  modified_base 13: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgatatgctacacaat

SEQ ID NO: 1241 - DNA, 17 bp, synthetic construct
  misc_feature 1..17: note = Description of sequence: CMP ID NO: 452_1
  source 1..17: mol_type = other DNA
  misc_feature 1..4: note = Backbone sugar is not deoxyribose
  misc_feature 14..17: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA adenine nucleoside
  modified_base 4: mod_base = OTHER; note = beta-D-oxy-LNA adenine nucleoside
  modified_base 16: mod_base = OTHER; note = beta-D-oxy-LNA adenine nucleoside
  modified_base 14: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
atgatatgatatgctac

SEQ ID NO: 1242 - DNA, 18 bp, synthetic construct
  misc_feature 1..18: note = Description of sequence: CMP ID NO: 453_1
  source 1..18: mol_type = other DNA
  misc_feature 1..4: note = Backbone sugar is not deoxyribose
  misc_feature 15..18: note = Backbone sugar is not deoxyribose
  modified_base 15: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 17: mod_base = OTHER; note = beta-D-oxy-LNA adenine nucleoside
  modified_base 18: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
gaggagagagacaataaa

SEQ ID NO: 1243 - DNA, 17 bp, synthetic construct
  misc_feature 1..17: note = Description of sequence: CMP ID NO: 454_1
  source 1..17: mol_type = other DNA
  misc_feature 1..3: note = Backbone sugar is not deoxyribose
  misc_feature 15..17: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  modified_base 17: mod_base = OTHER; note = beta-D-oxy-LNA adenine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
ctaggaggagagagaca

SEQ ID NO: 1244 - DNA, 17 bp, synthetic construct
  misc_feature 1..17: note = Description of sequence: CMP ID NO: 455_1
  source 1..17: mol_type = other DNA
  misc_feature 1..4: note = Backbone sugar is not deoxyribose
  misc_feature 15..17: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 4: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 17: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tattctaggaggagaga

SEQ ID NO: 1245 - DNA, 17 bp, synthetic construct
  misc_feature 1..17: note = Description of sequence: CMP ID NO: 456_1
  source 1..17: mol_type = other DNA
  misc_feature 1..4: note = Backbone sugar is not deoxyribose
  misc_feature 15..17: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 4: mod_base = OTHER; note = beta-D-oxy-LNA thymine nucleoside
  modified_base 3: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
ttatattctaggaggag

SEQ ID NO: 1246 - DNA, 16 bp, synthetic construct
  misc_feature 1..16: note = Description of sequence: CMP ID NO: 457_1
  source 1..16: mol_type = other DNA
  misc_feature 1..3: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtttatattctaggag

SEQ ID NO: 1247 - DNA, 18 bp, synthetic construct
  misc_feature 1..18: note = Description of sequence: CMP ID NO: 458_1
  source 1..18: mol_type = other DNA
  misc_feature 1..2: note = Backbone sugar is not deoxyribose
  misc_feature 15..18: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tggagtttatattctagg

SEQ ID NO: 1248 - DNA, 16 bp, synthetic construct
  misc_feature 1..16: note = Description of sequence: CMP ID NO: 459_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cgtaccaccactctgc

SEQ ID NO: 1249 - DNA, 18 bp, synthetic construct
  misc_feature 1..18: note = Description of sequence: CMP ID NO: 460_1
  source 1..18: mol_type = other DNA
  misc_feature 1..4: note = Backbone sugar is not deoxyribose
  misc_feature 15..18: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 17: mod_base = OTHER; note = beta-D-oxy-LNA thymine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tgaggaaatcattcattc

SEQ ID NO: 1250 - DNA, 18 bp, synthetic construct
  misc_feature 1..18: note = Description of sequence: CMP ID NO: 461_1
  source 1..18: mol_type = other DNA
  misc_feature 1..4: note = Backbone sugar is not deoxyribose
  misc_feature 15..18: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA thymine nucleoside
  modified_base 18: mod_base = OTHER; note = beta-D-oxy-LNA thymine nucleoside
  modified_base 17: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tttgaggaaatcattcat

SEQ ID NO: 1251 - DNA, 16 bp, synthetic construct
  misc_feature 1..16: note = Description of sequence: CMP ID NO: 462_1
  source 1..16: mol_type = other DNA
  misc_feature 1..4: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aggctaatcctatttg

SEQ ID NO: 1252 - DNA, 16 bp, synthetic construct
  misc_feature 1..16: note = Description of sequence: CMP ID NO: 463_1
  source 1..16: mol_type = other DNA
  misc_feature 1..4: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA thymine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 13: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tttaggctaatcctat

SEQ ID NO: 1253 - DNA, 16 bp, synthetic construct
  misc_feature 1..16: note = Description of sequence: CMP ID NO: 464_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgctccagtgtaccct

SEQ ID NO: 1254 - DNA, 16 bp, synthetic construct
  misc_feature 1..16: note = Description of sequence: CMP ID NO: 465_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  modified_base 2: mod_base = OTHER; note = beta-D-oxy-LNA adenine nucleoside
  modified_base 13: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tagtagtactcgatag

SEQ ID NO: 1255 - DNA, 18 bp, synthetic construct
  misc_feature 1..18: note = Description of sequence: CMP ID NO: 466_1
  source 1..18: mol_type = other DNA
  misc_feature 1..3: note = Backbone sugar is not deoxyribose
  misc_feature 16..18: note = Backbone sugar is not deoxyribose
  modified_base 2: mod_base = OTHER; note = beta-D-oxy-LNA thymine nucleoside
  modified_base 17: mod_base = OTHER; note = beta-D-oxy-LNA thymine nucleoside
  modified_base 3: mod_base = OTHER; note = beta-D-oxy-LNA adenine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
ctaattgtagtagtactc

SEQ ID NO: 1256 - DNA, 16 bp, synthetic construct
  misc_feature 1..16: note = Description of sequence: CMP ID NO: 467_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 13: mod_base = OTHER; note = beta-D-oxy-LNA thymine nucleoside
  modified_base 16: mod_base = OTHER; note = beta-D-oxy-LNA thymine nucleoside
  modified_base 14: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgctaattgtagtagt

SEQ ID NO: 1257 - DNA, 16 bp, synthetic construct
  misc_feature 1..16: note = Description of sequence: CMP ID NO: 468_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agtgctaattgtagta

SEQ ID NO: 1258 - DNA, 16 bp, synthetic construct
  misc_feature 1..16: note = Description of sequence: CMP ID NO: 469_1
  source 1..16: mol_type = other DNA
  misc_feature 1..4: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcaagtgctaattgta

SEQ ID NO: 1259 - DNA, 19 bp, synthetic construct
  misc_feature 1..19: note = Description of sequence: CMP ID NO: 470_1
  source 1..19: mol_type = other DNA
  misc_feature 1..4: note = Backbone sugar is not deoxyribose
  misc_feature 18..19: note = Backbone sugar is not deoxyribose
  modified_base 18: mod_base = OTHER; note = beta-D-oxy-LNA thymine nucleoside
  modified_base 2: mod_base = OTHER; note = beta-D-oxy-LNA adenine nucleoside
  modified_base 19: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
gaggaaatgaactaattta

SEQ ID NO: 1260 - DNA, 17 bp, synthetic construct
  misc_feature 1..17: note = Description of sequence: CMP ID NO: 471_1
  source 1..17: mol_type = other DNA
  misc_feature 1..4: note = Backbone sugar is not deoxyribose
  misc_feature 16..17: note = Backbone sugar is not deoxyribose
  modified_base 16: mod_base = OTHER; note = beta-D-oxy-LNA thymine nucleoside
  modified_base 2: mod_base = OTHER; note = beta-D-oxy-LNA adenine nucleoside
  modified_base 17: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
caggaggaaatgaacta

SEQ ID NO: 1261 - DNA, 16 bp, synthetic construct
  misc_feature 1..16: note = Description of sequence: CMP ID NO: 472_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ccctagagtcatttcc

SEQ ID NO: 1262 - DNA, 17 bp, synthetic construct
  misc_feature 1..17: note = Description of sequence: CMP ID NO: 473_1
  source 1..17: mol_type = other DNA
  misc_feature 1..3: note = Backbone sugar is not deoxyribose
  misc_feature 15..17: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA adenine nucleoside
  modified_base 3: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
atcttacatgatgaagc

SEQ ID NO: 1263 - DNA, 19 bp, synthetic construct
  misc_feature 1..19: note = Description of sequence: CMP ID NO: 475_1
  source 1..19: mol_type = other DNA
  misc_feature 1..2: note = Backbone sugar is not deoxyribose
  misc_feature 18..19: note = Backbone sugar is not deoxyribose
  modified_base 1: mod_base = OTHER; note = beta-D-oxy-LNA adenine nucleoside
  modified_base 18: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
agacacactcagatttcag

SEQ ID NO: 1264 - DNA, 18 bp, synthetic construct
  misc_feature 1..18: note = Description of sequence: CMP ID NO: 474_1
  source 1..18: mol_type = other DNA
  misc_feature 1..3: note = Backbone sugar is not deoxyribose
  misc_feature 17..18: note = Backbone sugar is not deoxyribose
  modified_base 2: mod_base = OTHER; note = beta-D-oxy-LNA adenine nucleoside
  modified_base 17: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
gacacactcagatttcag

SEQ ID NO: 1265 - DNA, 20 bp, synthetic construct
  misc_feature 1..20: note = Description of sequence: CMP ID NO: 476_1
  source 1..20: mol_type = other DNA
  misc_feature 1..3: note = Backbone sugar is not deoxyribose
  misc_feature 19..20: note = Backbone sugar is not deoxyribose
  modified_base 1: mod_base = OTHER; note = beta-D-oxy-LNA adenine nucleoside
  modified_base 2: mod_base = OTHER; note = beta-D-oxy-LNA adenine nucleoside
  modified_base 19: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
aagacacactcagatttcag

SEQ ID NO: 1266 - DNA, 18 bp, synthetic construct
  misc_feature 1..18: note = Description of sequence: CMP ID NO: 477_1
  source 1..18: mol_type = other DNA
  misc_feature 1..2: note = Backbone sugar is not deoxyribose
  misc_feature 16..18: note = Backbone sugar is not deoxyribose
  modified_base 16: mod_base = OTHER; note = beta-D-oxy-LNA thymine nucleoside
  modified_base 1: mod_base = OTHER; note = beta-D-oxy-LNA adenine nucleoside
  modified_base 18: mod_base = OTHER; note = beta-D-oxy-LNA adenine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
agacacactcagatttca

SEQ ID NO: 1267 - DNA, 19 bp, synthetic construct
  misc_feature 1..19: note = Description of sequence: CMP ID NO: 478_1
  source 1..19: mol_type = other DNA
  misc_feature 1..3: note = Backbone sugar is not deoxyribose
  misc_feature 17..19: note = Backbone sugar is not deoxyribose
  modified_base 17: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 19: mod_base = OTHER; note = beta-D-oxy-LNA adenine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
aagacacactcagatttca

SEQ ID NO: 1268 - DNA, 20 bp, synthetic construct
  misc_feature 1..20: note = Description of sequence: CMP ID NO: 479_1
  source 1..20: mol_type = other DNA
  misc_feature 1..2: note = Backbone sugar is not deoxyribose
  misc_feature 17..20: note = Backbone sugar is not deoxyribose
  modified_base 17: mod_base = OTHER; note = beta-D-oxy-LNA thymine nucleoside
  modified_base 18: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 20: mod_base = OTHER; note = beta-D-oxy-LNA adenine nucleoside
  modified_base 19: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
aaagacacactcagatttca

SEQ ID NO: 1269 - DNA, 20 bp, synthetic construct
  misc_feature 1..20: note = Description of sequence: CMP ID NO: 480_1
  source 1..20: mol_type = other DNA
  misc_feature 1..3: note = Backbone sugar is not deoxyribose
  misc_feature 18..20: note = Backbone sugar is not deoxyribose
  modified_base 18: mod_base = OTHER; note = beta-D-oxy-LNA thymine nucleoside
  modified_base 19: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 20: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
gaaagacacactcagatttc

SEQ ID NO: 1270 - DNA, 18 bp, synthetic construct
  misc_feature 1..18: note = Description of sequence: CMP ID NO: 481_1
  source 1..18: mol_type = other DNA
  misc_feature 1..4: note = Backbone sugar is not deoxyribose
  misc_feature 16..18: note = Backbone sugar is not deoxyribose
  modified_base 16: mod_base = OTHER; note = beta-D-oxy-LNA thymine nucleoside
  modified_base 17: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
aagacacactcagatttc

SEQ ID NO: 1271 - DNA, 19 bp, synthetic construct
  misc_feature 1..19: note = Description of sequence: CMP ID NO: 482_1
  source 1..19: mol_type = other DNA
  misc_feature 1..4: note = Backbone sugar is not deoxyribose
  misc_feature 16..19: note = Backbone sugar is not deoxyribose
  modified_base 16: mod_base = OTHER; note = beta-D-oxy-LNA thymine nucleoside
  modified_base 17: mod_base = OTHER; note = beta-D-oxy-LNA thymine nucleoside
  modified_base 18: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 19: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
aaagacacactcagatttc

SEQ ID NO: 1272 - DNA, 20 bp, synthetic construct
  misc_feature 1..20: note = Description of sequence: CMP ID NO: 483_1
  source 1..20: mol_type = other DNA
  misc_feature 1..4: note = Backbone sugar is not deoxyribose
  misc_feature 19..20: note = Backbone sugar is not deoxyribose
  modified_base 1: mod_base = OTHER; note = beta-D-oxy-LNA thymine nucleoside
  modified_base 19: mod_base = OTHER; note = beta-D-oxy-LNA thymine nucleoside
  modified_base 20: mod_base = OTHER; note = beta-D-oxy-LNA thymine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
tgaaagacacactcagattt

SEQ ID NO: 1273 - DNA, 19 bp, synthetic construct
  misc_feature 1..19: note = Description of sequence: CMP ID NO: 484_1
  source 1..19: mol_type = other DNA
  misc_feature 1..2: note = Backbone sugar is not deoxyribose
  misc_feature 16..19: note = Backbone sugar is not deoxyribose
  modified_base 1: mod_base = OTHER; note = beta-D-oxy-LNA thymine nucleoside
  modified_base 18: mod_base = OTHER; note = beta-D-oxy-LNA thymine nucleoside
  modified_base 19: mod_base = OTHER; note = beta-D-oxy-LNA thymine nucleoside
  modified_base 17: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
tgaaagacacactcagatt

SEQ ID NO: 1274 - DNA, 18 bp, synthetic construct
  misc_feature 1..18: note = Description of sequence: CMP ID NO: 485_1
  source 1..18: mol_type = other DNA
  misc_feature 1..3: note = Backbone sugar is not deoxyribose
  misc_feature 16..18: note = Backbone sugar is not deoxyribose
  modified_base 1: mod_base = OTHER; note = beta-D-oxy-LNA thymine nucleoside
  modified_base 18: mod_base = OTHER; note = beta-D-oxy-LNA thymine nucleoside
  modified_base 3: mod_base = OTHER; note = beta-D-oxy-LNA adenine nucleoside
  modified_base 17: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tgaaagacacactcagat

SEQ ID NO: 1275 - DNA, 17 bp, synthetic construct
  misc_feature 1..17: note = Description of sequence: CMP ID NO: 486_1
  source 1..17: mol_type = other DNA
  misc_feature 1..4: note = Backbone sugar is not deoxyribose
  misc_feature 15..17: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA adenine nucleoside
  modified_base 17: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
attgaaagacacactca

SEQ ID NO: 1276 - DNA, 17 bp, synthetic construct
  misc_feature 1..17: note = Description of sequence: CMP ID NO: 487_1
  source 1..17: mol_type = other DNA
  misc_feature 1..2: note = Backbone sugar is not deoxyribose
  misc_feature 14..17: note = Backbone sugar is not deoxyribose
  modified_base 1: mod_base = OTHER; note = beta-D-oxy-LNA thymine nucleoside
  modified_base 17: mod_base = OTHER; note = beta-D-oxy-LNA thymine nucleoside
  modified_base 15: mod_base = OTHER; note = beta-D-oxy-LNA adenine nucleoside
  modified_base 2: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tcattgaaagacacact

SEQ ID NO: 1277 - DNA, 16 bp, synthetic construct
  misc_feature 1..16: note = Description of sequence: CMP ID NO: 488_1
  source 1..16: mol_type = other DNA
  misc_feature 1..3: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 13: mod_base = OTHER; note = beta-D-oxy-LNA adenine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttccatcattgaaaga

SEQ ID NO: 1278 - DNA, 17 bp, synthetic construct
  misc_feature 1..17: note = Description of sequence: CMP ID NO: 489_1
  source 1..17: mol_type = other DNA
  misc_feature 1..4: note = Backbone sugar is not deoxyribose
  misc_feature 14..17: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 17: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
ataataccacttatcat

SEQ ID NO: 1279 - DNA, 18 bp, synthetic construct
  misc_feature 1..18: note = Description of sequence: CMP ID NO: 490_1
  source 1..18: mol_type = other DNA
  misc_feature 1..2: note = Backbone sugar is not deoxyribose
  misc_feature 15..18: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA thymine nucleoside
  modified_base 18: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
ttacttaatttctttgga

SEQ ID NO: 1280 - DNA, 18 bp, synthetic construct
  misc_feature 1..18: note = Description of sequence: CMP ID NO: 491_1
  source 1..18: mol_type = other DNA
  misc_feature 1..3: note = Backbone sugar is not deoxyribose
  misc_feature 16..18: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 18: mod_base = OTHER; note = beta-D-oxy-LNA adenine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
ttagaactagctttatca

SEQ ID NO: 1281 - DNA, 16 bp, synthetic construct
  misc_feature 1..16: note = Description of sequence: CMP ID NO: 492_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA adenine nucleoside
  modified_base 14: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gaggtacaaatatagg

SEQ ID NO: 1282 - DNA, 16 bp, synthetic construct
  misc_feature 1..16: note = Description of sequence: CMP ID NO: 493_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cttatgatacaactta

SEQ ID NO: 1283 - DNA, 16 bp, synthetic construct
  misc_feature 1..16: note = Description of sequence: CMP ID NO: 494_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcttatgatacaactt

SEQ ID NO: 1284 - DNA, 16 bp, synthetic construct
  misc_feature 1..16: note = Description of sequence: CMP ID NO: 495_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttcttatgatacaact

SEQ ID NO: 1285 - DNA, 16 bp, synthetic construct
  misc_feature 1..16: note = Description of sequence: CMP ID NO: 496_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cagtttcttatgatac

SEQ ID NO: 1286 - DNA, 16 bp, synthetic construct
  misc_feature 1..16: note = Description of sequence: CMP ID NO: 497_1
  source 1..16: mol_type = other DNA
  misc_feature 1..3: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 3: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcagtttcttatgata

SEQ ID NO: 1287 - DNA, 19 bp, synthetic construct
  misc_feature 1..19: note = Description of sequence: CMP ID NO: 498_1
  source 1..19: mol_type = other DNA
  misc_feature 1..4: note = Backbone sugar is not deoxyribose
  misc_feature 17..19: note = Backbone sugar is not deoxyribose
  modified_base 1: mod_base = OTHER; note = beta-D-oxy-LNA thymine nucleoside
  modified_base 18: mod_base = OTHER; note = beta-D-oxy-LNA thymine nucleoside
  modified_base 19: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
tacaaatgtctattaggtt

SEQ ID NO: 1288 - DNA, 18 bp, synthetic construct
  misc_feature 1..18: note = Description of sequence: CMP ID NO: 499_1
  source 1..18: mol_type = other DNA
  misc_feature 1..4: note = Backbone sugar is not deoxyribose
  misc_feature 16..18: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 16: mod_base = OTHER; note = beta-D-oxy-LNA thymine nucleoside
  modified_base 4: mod_base = OTHER; note = beta-D-oxy-LNA adenine nucleoside
  modified_base 17: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tgtacaaatgtctattag

SEQ ID NO: 1289 - DNA, 16 bp, synthetic construct
  misc_feature 1..16: note = Description of sequence: CMP ID NO: 500_1
  source 1..16: mol_type = other DNA
  misc_feature 1..3: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agcatcacaattagta

SEQ ID NO: 1290 - DNA, 16 bp, synthetic construct
  misc_feature 1..16: note = Description of sequence: CMP ID NO: 501_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA adenine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctaatgatagtgaagc

SEQ ID NO: 1291 - DNA, 16 bp, synthetic construct
  misc_feature 1..16: note = Description of sequence: CMP ID NO: 502_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agctaatgatagtgaa

SEQ ID NO: 1292 - DNA, 16 bp, synthetic construct
  misc_feature 1..16: note = Description of sequence: CMP ID NO: 503_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atgccttgacatatta

SEQ ID NO: 1293 - DNA, 17 bp, synthetic construct
  misc_feature 1..17: note = Description of sequence: CMP ID NO: 504_1
  source 1..17: mol_type = other DNA
  misc_feature 1..4: note = Backbone sugar is not deoxyribose
  misc_feature 14..17: note = Backbone sugar is not deoxyribose
  modified_base 2: mod_base = OTHER; note = beta-D-oxy-LNA thymine nucleoside
  modified_base 4: mod_base = OTHER; note = beta-D-oxy-LNA adenine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
ctcaagattattgacac

SEQ ID NO: 1294 - DNA, 16 bp, synthetic construct
  misc_feature 1..16: note = Description of sequence: CMP ID NO: 505_2
  source 1..16: mol_type = other DNA
  misc_feature 1..2: note = Backbone sugar is not deoxyribose
  misc_feature 13..16: note = Backbone sugar is not deoxyribose
  modified_base 13: mod_base = OTHER; note = beta-D-oxy-LNA thymine nucleoside
  modified_base 14: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acctcaagattattga

SEQ ID NO: 1295 - DNA, 16 bp, synthetic construct
  misc_feature 1..16: note = Description of sequence: CMP ID NO: 505_1
  source 1..16: mol_type = other DNA
  misc_feature 1..3: note = Backbone sugar is not deoxyribose
  misc_feature 13..16: note = Backbone sugar is not deoxyribose
  modified_base 13: mod_base = OTHER; note = beta-D-oxy-LNA thymine nucleoside
  modified_base 14: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acctcaagattattga

SEQ ID NO: 1296 - DNA, 16 bp, synthetic construct
  misc_feature 1..16: note = Description of sequence: CMP ID NO: 506_1
  source 1..16: mol_type = other DNA
  misc_feature 1..4: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 3: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aacctcaagattattg

SEQ ID NO: 1297 - DNA, 19 bp, synthetic construct
  misc_feature 1..19: note = Description of sequence: CMP ID NO: 507_1
  source 1..19: mol_type = other DNA
  misc_feature 1..4: note = Backbone sugar is not deoxyribose
  misc_feature 18..19: note = Backbone sugar is not deoxyribose
  modified_base 18: mod_base = OTHER; note = beta-D-oxy-LNA thymine nucleoside
  modified_base 19: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 1: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
cacaaacctcaagattatt

SEQ ID NO: 1298 - DNA, 16 bp, synthetic construct
  misc_feature 1..16: note = Description of sequence: CMP ID NO: 508_1
  source 1..16: mol_type = other DNA
  misc_feature 1..3: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 13: mod_base = OTHER; note = beta-D-oxy-LNA adenine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtacttaattagacct

SEQ ID NO: 1299 - DNA, 16 bp, synthetic construct
  misc_feature 1..16: note = Description of sequence: CMP ID NO: 509_1
  source 1..16: mol_type = other DNA
  misc_feature 1..4: note = Backbone sugar is not deoxyribose
  misc_feature 14..16: note = Backbone sugar is not deoxyribose
  modified_base 3: mod_base = OTHER; note = beta-D-oxy-LNA thymine nucleoside
  modified_base 1: mod_base = OTHER; note = beta-D-oxy-LNA adenine nucleoside
  modified_base 4: mod_base = OTHER; note = beta-D-oxy-LNA adenine nucleoside
  modified_base 14: mod_base = OTHER; note = beta-D-oxy-LNA adenine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agtacttaattagacc

SEQ ID NO: 1300 - DNA, 16 bp, synthetic construct
  misc_feature 1..16: note = Description of sequence: CMP ID NO: 510_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 4: mod_base = OTHER; note = beta-D-oxy-LNA thymine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtatgaggtggtaaac

SEQ ID NO: 1301 - DNA, 17 bp, synthetic construct
  misc_feature 1..17: note = Description of sequence: CMP ID NO: 511_1
  source 1..17: mol_type = other DNA
  misc_feature 1..2: note = Backbone sugar is not deoxyribose
  misc_feature 14..17: note = Backbone sugar is not deoxyribose
  modified_base 16: mod_base = OTHER; note = beta-D-oxy-LNA thymine nucleoside
  modified_base 1: mod_base = OTHER; note = beta-D-oxy-LNA adenine nucleoside
  modified_base 14: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
aggaaacagcagaagtg

SEQ ID NO: 1302 - DNA, 16 bp, synthetic construct
  misc_feature 1..16: note = Description of sequence: CMP ID NO: 512_1
  source 1..16: mol_type = other DNA
  misc_feature 1..2: note = Backbone sugar is not deoxyribose
  misc_feature 15..16: note = Backbone sugar is not deoxyribose
  modified_base 15: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcacaacccagaggaa

SEQ ID NO: 1303 - DNA, 16 bp, synthetic construct
  misc_feature 1..16: note = Description of sequence: CMP ID NO: 513_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA adenine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
caagcacaacccagag

SEQ ID NO: 1304 - DNA, 16 bp, synthetic construct
  misc_feature 1..16: note = Description of sequence: CMP ID NO: 514_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA adenine nucleoside
  modified_base 3: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttcaagcacaacccag

SEQ ID NO: 1305 - DNA, 16 bp, synthetic construct
  misc_feature 1..16: note = Description of sequence: CMP ID NO: 515_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA adenine nucleoside
  modified_base 2: mod_base = OTHER; note = beta-D-oxy-LNA adenine nucleoside
  modified_base 13: mod_base = OTHER; note = beta-D-oxy-LNA adenine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aattcaagcacaaccc

SEQ ID NO: 1306 - DNA, 19 bp, synthetic construct
  misc_feature 1..19: note = Description of sequence: CMP ID NO: 516_1
  source 1..19: mol_type = other DNA
  misc_feature 1..4: note = Backbone sugar is not deoxyribose
  misc_feature 18..19: note = Backbone sugar is not deoxyribose
  modified_base 1: mod_base = OTHER; note = beta-D-oxy-LNA thymine nucleoside
  modified_base 4: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 18: mod_base = OTHER; note = beta-D-oxy-LNA 5-methyl cytosine nucleoside
  modified_base 19: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
taataattcaagcacaacc

SEQ ID NO: 1307 - DNA, 17 bp, synthetic construct
  misc_feature 1..17: note = Description of sequence: CMP ID NO: 517_1
  source 1..17: mol_type = other DNA
  misc_feature 1..4: note = Backbone sugar is not deoxyribose
  misc_feature 14..17: note = Backbone sugar is not deoxyribose
  modified_base 3: mod_base = OTHER; note = beta-D-oxy-LNA thymine nucleoside
  modified_base 1: mod_base = OTHER; note = beta-D-oxy-LNA adenine nucleoside
  modified_base 4: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
actaataattcaagcac

SEQ ID NO: 1308 - DNA, 20 bp, synthetic construct
  misc_feature 1..20: note = Description of sequence: CMP ID NO: 518_1
  source 1..20: mol_type = other DNA
  misc_feature 1..4: note = Backbone sugar is not deoxyribose
  misc_feature 17..20: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 17: mod_base = OTHER; note = beta-D-oxy-LNA adenine nucleoside
  modified_base 18: mod_base = OTHER; note = beta-D-oxy-LNA adenine nucleoside
  modified_base 20: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
ataatactaataattcaagc

SEQ ID NO: 1309 - DNA, 16 bp, synthetic construct
  misc_feature 1..16: note = Description of sequence: CMP ID NO: 519_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tagatttgtgaggtaa

SEQ ID NO: 1310 - DNA, 16 bp, synthetic construct
  misc_feature 1..16: note = Description of sequence: CMP ID NO: 520_1
  source 1..16: mol_type = other DNA
  misc_feature 1..4: note = Backbone sugar is not deoxyribose
  misc_feature 15..16: note = Backbone sugar is not deoxyribose
  modified_base 16: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA adenine nucleoside
  modified_base 3: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agccttaattctccat

SEQ ID NO: 1311 - DNA, 17 bp, synthetic construct
  misc_feature 1..17: note = Description of sequence: CMP ID NO: 521_1
  source 1..17: mol_type = other DNA
  misc_feature 1..4: note = Backbone sugar is not deoxyribose
  misc_feature 14..17: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 17: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
aatgatctagagcctta

SEQ ID NO: 1312 - DNA, 16 bp, synthetic construct
  misc_feature 1..16: note = Description of sequence: CMP ID NO: 522_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA adenine nucleoside
  modified_base 1: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctaatgatctagagcc

SEQ ID NO: 1313 - DNA, 16 bp, synthetic construct
  misc_feature 1..16: note = Description of sequence: CMP ID NO: 523_1
  source 1..16: mol_type = other DNA
  misc_feature 1..3: note = Backbone sugar is not deoxyribose
  misc_feature 13..16: note = Backbone sugar is not deoxyribose
  modified_base 3: mod_base = OTHER; note = beta-D-oxy-LNA thymine nucleoside
  modified_base 1: mod_base = OTHER; note = beta-D-oxy-LNA adenine nucleoside
  modified_base 14: mod_base = OTHER; note = beta-D-oxy-LNA adenine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
actaatgatctagagc

SEQ ID NO: 1314 - DNA, 18 bp, synthetic construct
  misc_feature 1..18: note = Description of sequence: CMP ID NO: 524_1
  source 1..18: mol_type = other DNA
  misc_feature 1..3: note = Backbone sugar is not deoxyribose
  misc_feature 15..18: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 17: mod_base = OTHER; note = beta-D-oxy-LNA thymine nucleoside
  modified_base 18: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
cattaacatgttcttatt

SEQ ID NO: 1315 - DNA, 20 bp, synthetic construct
  misc_feature 1..20: note = Description of sequence: CMP ID NO: 525_1
  source 1..20: mol_type = other DNA
  misc_feature 1..4: note = Backbone sugar is not deoxyribose
  misc_feature 17..20: note = Backbone sugar is not deoxyribose
  modified_base 18: mod_base = OTHER; note = beta-D-oxy-LNA thymine nucleoside
  modified_base 19: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 2: mod_base = OTHER; note = beta-D-oxy-LNA 5-methyl cytosine nucleoside
  modified_base 20: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
acaagtacattaacatgttc

SEQ ID NO: 1316 - DNA, 19 bp, synthetic construct
  misc_feature 1..19: note = Description of sequence: CMP ID NO: 526_1
  source 1..19: mol_type = other DNA
  misc_feature 1..4: note = Backbone sugar is not deoxyribose
  misc_feature 16..19: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 18: mod_base = OTHER; note = beta-D-oxy-LNA thymine nucleoside
  modified_base 3: mod_base = OTHER; note = beta-D-oxy-LNA adenine nucleoside
  modified_base 17: mod_base = OTHER; note = beta-D-oxy-LNA adenine nucleoside
  modified_base 4: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
ttacaagtacattaacatg

SEQ ID NO: 1317 - DNA, 17 bp, synthetic construct
  misc_feature 1..17: note = Description of sequence: CMP ID NO: 527_1
  source 1..17: mol_type = other DNA
  misc_feature 1..4: note = Backbone sugar is not deoxyribose
  misc_feature 14..17: note = Backbone sugar is not deoxyribose
  modified_base 3: mod_base = OTHER; note = beta-D-oxy-LNA thymine nucleoside
  modified_base 4: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA thymine nucleoside
  modified_base 17: mod_base = OTHER; note = beta-D-oxy-LNA thymine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
gctttattcatgtttat

SEQ ID NO: 1318 - DNA, 16 bp, synthetic construct
  misc_feature 1..16: note = Description of sequence: CMP ID NO: 528_1
  source 1..16: mol_type = other DNA
  misc_feature 1..3: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gctttattcatgttta

SEQ ID NO: 1319 - DNA, 18 bp, synthetic construct
  misc_feature 1..18: note = Description of sequence: CMP ID NO: 529_1
  source 1..18: mol_type = other DNA
  misc_feature 1..3: note = Backbone sugar is not deoxyribose
  misc_feature 17..18: note = Backbone sugar is not deoxyribose
  modified_base 17: mod_base = OTHER; note = beta-D-oxy-LNA thymine nucleoside
  modified_base 18: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
agagctttattcatgttt

SEQ ID NO: 1320 - DNA, 18 bp, synthetic construct
  misc_feature 1..18: note = Description of sequence: CMP ID NO: 530_1
  source 1..18: mol_type = other DNA
  misc_feature 1..4: note = Backbone sugar is not deoxyribose
  misc_feature 15..18: note = Backbone sugar is not deoxyribose
  modified_base 2: mod_base = OTHER; note = beta-D-oxy-LNA thymine nucleoside
  modified_base 17: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
ataagagctttattcatg

SEQ ID NO: 1321 - DNA, 17 bp, synthetic construct
  misc_feature 1..17: note = Description of sequence: CMP ID NO: 531_1
  source 1..17: mol_type = other DNA
  misc_feature 1..4: note = Backbone sugar is not deoxyribose
  misc_feature 14..17: note = Backbone sugar is not deoxyribose
  modified_base 3: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 17: mod_base = OTHER; note = beta-D-oxy-LNA adenine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
cataagagctttattca

SEQ ID NO: 1322 - DNA, 16 bp, synthetic construct
  misc_feature 1..16: note = Description of sequence: CMP ID NO: 532_1
  source 1..16: mol_type = other DNA
  misc_feature 1..4: note = Backbone sugar is not deoxyribose
  misc_feature 13..16: note = Backbone sugar is not deoxyribose
  modified_base 13: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agcataagagctttat

SEQ ID NO: 1323 - DNA, 16 bp, synthetic construct
  misc_feature 1..16: note = Description of sequence: CMP ID NO: 533_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tagattgtttagtgca

SEQ ID NO: 1324 - DNA, 16 bp, synthetic construct
  misc_feature 1..16: note = Description of sequence: CMP ID NO: 534_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtagattgtttagtgc

SEQ ID NO: 1325 - DNA, 17 bp, synthetic construct
  misc_feature 1..17: note = Description of sequence: CMP ID NO: 535_1
  source 1..17: mol_type = other DNA
  misc_feature 1..4: note = Backbone sugar is not deoxyribose
  misc_feature 14..17: note = Backbone sugar is not deoxyribose
  modified_base 16: mod_base = OTHER; note = beta-D-oxy-LNA thymine nucleoside
  modified_base 17: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
gacaattctagtagatt

SEQ ID NO: 1326 - DNA, 16 bp, synthetic construct
  misc_feature 1..16: note = Description of sequence: CMP ID NO: 536_1
  source 1..16: mol_type = other DNA
  misc_feature 1..3: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctgacaattctagtag

SEQ ID NO: 1327 - DNA, 16 bp, synthetic construct
  misc_feature 1..16: note = Description of sequence: CMP ID NO: 537_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gctgacaattctagta

SEQ ID NO: 1328 - DNA, 16 bp, synthetic construct
  misc_feature 1..16: note = Description of sequence: CMP ID NO: 538_1
  source 1..16: mol_type = other DNA
  misc_feature 1..2: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aggattaagatacgta

SEQ ID NO: 1329 - DNA, 16 bp, synthetic construct
  misc_feature 1..16: note = Description of sequence: CMP ID NO: 539_1
  source 1..16: mol_type = other DNA
  misc_feature 1..2: note = Backbone sugar is not deoxyribose
  misc_feature 14..16: note = Backbone sugar is not deoxyribose
  modified_base 16: mod_base = OTHER; note = beta-D-oxy-LNA thymine nucleoside
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
caggattaagatacgt

SEQ ID NO: 1330 - DNA, 16 bp, synthetic construct
  misc_feature 1..16: note = Description of sequence: CMP ID NO: 540_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA adenine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcaggattaagatacg

SEQ ID NO: 1331 - DNA, 16 bp, synthetic construct
  misc_feature 1..16: note = Description of sequence: CMP ID NO: 541_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 14: mod_base = OTHER; note = beta-D-oxy-LNA thymine nucleoside
  modified_base 13: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttcaggattaagatac

SEQ ID NO: 1332 - DNA, 18 bp, synthetic construct
  misc_feature 1..18: note = Description of sequence: CMP ID NO: 542_1
  source 1..18: mol_type = other DNA
  misc_feature 1..4: note = Backbone sugar is not deoxyribose
  misc_feature 15..18: note = Backbone sugar is not deoxyribose
  modified_base 16: mod_base = OTHER; note = beta-D-oxy-LNA thymine nucleoside
  modified_base 17: mod_base = OTHER; note = beta-D-oxy-LNA thymine nucleoside
  modified_base 1: mod_base = OTHER; note = beta-D-oxy-LNA adenine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
aggaagaaagtttgattc

SEQ ID NO: 1333 - DNA, 18 bp, synthetic construct
  misc_feature 1..18: note = Description of sequence: CMP ID NO: 543_1
  source 1..18: mol_type = other DNA
  misc_feature 1..4: note = Backbone sugar is not deoxyribose
  misc_feature 15..18: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 18: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tcaaggaagaaagtttga

SEQ ID NO: 1334 - DNA, 18 bp, synthetic construct
  misc_feature 1..18: note = Description of sequence: CMP ID NO: 544_1
  source 1..18: mol_type = other DNA
  misc_feature 1..4: note = Backbone sugar is not deoxyribose
  misc_feature 15..18: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 17: mod_base = OTHER; note = beta-D-oxy-LNA thymine nucleoside
  modified_base 4: mod_base = OTHER; note = beta-D-oxy-LNA adenine nucleoside
  modified_base 1: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
ctcaaggaagaaagtttg

SEQ ID NO: 1335 - DNA, 17 bp, synthetic construct
  misc_feature 1..17: note = Description of sequence: CMP ID NO: 545_1
  source 1..17: mol_type = other DNA
  misc_feature 1..3: note = Backbone sugar is not deoxyribose
  misc_feature 14..17: note = Backbone sugar is not deoxyribose
  modified_base 1: mod_base = OTHER; note = beta-D-oxy-LNA thymine nucleoside
  modified_base 17: mod_base = OTHER; note = beta-D-oxy-LNA thymine nucleoside
  modified_base 14: mod_base = OTHER; note = beta-D-oxy-LNA adenine nucleoside
  modified_base 15: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tgctcaaggaagaaagt

SEQ ID NO: 1336 - DNA, 18 bp, synthetic construct
  misc_feature 1..18: note = Description of sequence: CMP ID NO: 546_1
  source 1..18: mol_type = other DNA
  misc_feature 1..4: note = Backbone sugar is not deoxyribose
  misc_feature 16..18: note = Backbone sugar is not deoxyribose
  modified_base 3: mod_base = OTHER; note = beta-D-oxy-LNA thymine nucleoside
  modified_base 4: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 18: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
aattatgctcaaggaaga

SEQ ID NO: 1337 - DNA, 18 bp, synthetic construct
  misc_feature 1..18: note = Description of sequence: CMP ID NO: 547_1
  source 1..18: mol_type = other DNA
  misc_feature 1..4: note = Backbone sugar is not deoxyribose
  misc_feature 17..18: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA adenine nucleoside
  modified_base 18: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
taggataccacattatga

SEQ ID NO: 1338 - DNA, 20 bp, synthetic construct
  misc_feature 1..20: note = Description of sequence: CMP ID NO: 548_1
  source 1..20: mol_type = other DNA
  misc_feature 1..2: note = Backbone sugar is not deoxyribose
  misc_feature 18..20: note = Backbone sugar is not deoxyribose
  modified_base 19: mod_base = OTHER; note = beta-D-oxy-LNA thymine nucleoside
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  modified_base 18: mod_base = OTHER; note = beta-D-oxy-LNA 5-methyl cytosine nucleoside
  modified_base 20: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
cataatttattccattcctc

SEQ ID NO: 1339 - DNA, 17 bp, synthetic construct
  misc_feature 1..17: note = Description of sequence: CMP ID NO: 549_1
  source 1..17: mol_type = other DNA
  misc_feature 1..4: note = Backbone sugar is not deoxyribose
  misc_feature 15..17: note = Backbone sugar is not deoxyribose
  modified_base 1: mod_base = OTHER; note = beta-D-oxy-LNA thymine nucleoside
  modified_base 17: mod_base = OTHER; note = beta-D-oxy-LNA thymine nucleoside
  modified_base 4: mod_base = OTHER; note = beta-D-oxy-LNA adenine nucleoside
  modified_base 16: mod_base = OTHER; note = beta-D-oxy-LNA adenine nucleoside
  modified_base 3: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tgcataatttattccat

SEQ ID NO: 1340 - DNA, 17 bp, synthetic construct
  misc_feature 1..17: note = Description of sequence: CMP ID NO: 550_1
  source 1..17: mol_type = other DNA
  misc_feature 1..4: note = Backbone sugar is not deoxyribose
  misc_feature 15..17: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
actgcataatttattcc

SEQ ID NO: 1341 - DNA, 19 bp, synthetic construct
  misc_feature 1..19: note = Description of sequence: CMP ID NO: 551_1
  source 1..19: mol_type = other DNA
  misc_feature 1..4: note = Backbone sugar is not deoxyribose
  misc_feature 16..19: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 18: mod_base = OTHER; note = beta-D-oxy-LNA thymine nucleoside
  modified_base 19: mod_base = OTHER; note = beta-D-oxy-LNA thymine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 17: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
ctaaactgcataatttatt

SEQ ID NO: 1342 - DNA, 16 bp, synthetic construct
  misc_feature 1..16: note = Description of sequence: CMP ID NO: 552_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA adenine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  modified_base 13: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ataactaaactgcata

SEQ ID NO: 1343 - DNA, 19 bp, synthetic construct
  misc_feature 1..19: note = Description of sequence: CMP ID NO: 553_1
  source 1..19: mol_type = other DNA
  misc_feature 1..3: note = Backbone sugar is not deoxyribose
  misc_feature 16..19: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 17: mod_base = OTHER; note = beta-D-oxy-LNA thymine nucleoside
  modified_base 3: mod_base = OTHER; note = beta-D-oxy-LNA adenine nucleoside
  modified_base 16: mod_base = OTHER; note = beta-D-oxy-LNA 5-methyl cytosine nucleoside
  modified_base 19: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
ttattaataactaaactgc

SEQ ID NO: 1344 - DNA, 19 bp, synthetic construct
  misc_feature 1..19: note = Description of sequence: CMP ID NO: 554_1
  source 1..19: mol_type = other DNA
  misc_feature 1..4: note = Backbone sugar is not deoxyribose
  misc_feature 18..19: note = Backbone sugar is not deoxyribose
  modified_base 1: mod_base = OTHER; note = beta-D-oxy-LNA thymine nucleoside
  modified_base 4: mod_base = OTHER; note = beta-D-oxy-LNA thymine nucleoside
  modified_base 19: mod_base = OTHER; note = beta-D-oxy-LNA thymine nucleoside
  modified_base 2: mod_base = OTHER; note = beta-D-oxy-LNA adenine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
tagtacattattaataact

SEQ ID NO: 1345 - DNA, 16 bp, synthetic construct
  misc_feature 1..16: note = Description of sequence: CMP ID NO: 555_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cataactaaggacgtt

SEQ ID NO: 1346 - DNA, 16 bp, synthetic construct
  misc_feature 1..16: note = Description of sequence: CMP ID NO: 556_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcataactaaggacgt

SEQ ID NO: 1347 - DNA, 16 bp, synthetic construct
  misc_feature 1..16: note = Description of sequence: CMP ID NO: 557_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cgtcataactaaggac

SEQ ID NO: 1348 - DNA, 16 bp, synthetic construct
  misc_feature 1..16: note = Description of sequence: CMP ID NO: 558_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcgtcataactaagga

SEQ ID NO: 1349 - DNA, 16 bp, synthetic construct
  misc_feature 1..16: note = Description of sequence: CMP ID NO: 559_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 13: mod_base = OTHER; note = beta-D-oxy-LNA adenine nucleoside
  modified_base 14: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atcgtcataactaagg

SEQ ID NO: 1350 - DNA, 16 bp, synthetic construct
  misc_feature 1..16: note = Description of sequence: CMP ID NO: 560_1
  source 1..16: mol_type = other DNA
  misc_feature 1..2: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 14: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gttagtatcttacatt

SEQ ID NO: 1351 - DNA, 16 bp, synthetic construct
  misc_feature 1..16: note = Description of sequence: CMP ID NO: 561_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 14: mod_base = OTHER; note = beta-D-oxy-LNA adenine nucleoside
  modified_base 1: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctctattgttagtatc

SEQ ID NO: 1352 - DNA, 16 bp, synthetic construct
  misc_feature 1..16: note = Description of sequence: CMP ID NO: 562_1
  source 1..16: mol_type = other DNA
  misc_feature 1..3: note = Backbone sugar is not deoxyribose
  misc_feature 14..16: note = Backbone sugar is not deoxyribose
  modified_base 3: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agtatagagttactgt

SEQ ID NO: 1353 - DNA, 16 bp, synthetic construct
  misc_feature 1..16: note = Description of sequence: CMP ID NO: 563_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttcctggtgatacttt

SEQ ID NO: 1354 - DNA, 16 bp, synthetic construct
  misc_feature 1..16: note = Description of sequence: CMP ID NO: 564_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gttcctggtgatactt

SEQ ID NO: 1355 - DNA, 16 bp, synthetic construct
  misc_feature 1..16: note = Description of sequence: CMP ID NO: 565_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgttcctggtgatact

SEQ ID NO: 1356 - DNA, 18 bp, synthetic construct
  misc_feature 1..18: note = Description of sequence: CMP ID NO: 566_1
  source 1..18: mol_type = other DNA
  misc_feature 1..2: note = Backbone sugar is not deoxyribose
  misc_feature 15..18: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
ataaacatgaatctctcc

SEQ ID NO: 1357 - DNA, 19 bp, synthetic construct
  misc_feature 1..19: note = Description of sequence: CMP ID NO: 567_1
  source 1..19: mol_type = other DNA
  misc_feature 1..3: note = Backbone sugar is not deoxyribose
  misc_feature 16..19: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 16: mod_base = OTHER; note = beta-D-oxy-LNA thymine nucleoside
  modified_base 18: mod_base = OTHER; note = beta-D-oxy-LNA thymine nucleoside
  modified_base 1: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  modified_base 19: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
ctttataaacatgaatctc

SEQ ID NO: 1358 - DNA, 17 bp, synthetic construct
  misc_feature 1..17: note = Description of sequence: CMP ID NO: 568_1
  source 1..17: mol_type = other DNA
  misc_feature 1..3: note = Backbone sugar is not deoxyribose
  misc_feature 14..17: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
ctgtctttataaacatg

SEQ ID NO: 1359 - DNA, 18 bp, synthetic construct
  misc_feature 1..18: note = Description of sequence: CMP ID NO: 569_1
  source 1..18: mol_type = other DNA
  misc_feature 1..2: note = Backbone sugar is not deoxyribose
  misc_feature 15..18: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA thymine nucleoside
  modified_base 17: mod_base = OTHER; note = beta-D-oxy-LNA thymine nucleoside
  modified_base 18: mod_base = OTHER; note = beta-D-oxy-LNA thymine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
ttgttataaatctgtctt

SEQ ID NO: 1360 - DNA, 19 bp, synthetic construct
  misc_feature 1..19: note = Description of sequence: CMP ID NO: 570_1
  source 1..19: mol_type = other DNA
  misc_feature 1..3: note = Backbone sugar is not deoxyribose
  misc_feature 16..19: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 18: mod_base = OTHER; note = beta-D-oxy-LNA thymine nucleoside
  modified_base 3: mod_base = OTHER; note = beta-D-oxy-LNA adenine nucleoside
  modified_base 17: mod_base = OTHER; note = beta-D-oxy-LNA adenine nucleoside
  modified_base 19: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
ttaaatttattcttggata

SEQ ID NO: 1361 - DNA, 18 bp, synthetic construct
  misc_feature 1..18: note = Description of sequence: CMP ID NO: 571_1
  source 1..18: mol_type = other DNA
  misc_feature 1..2: note = Backbone sugar is not deoxyribose
  misc_feature 15..18: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 18: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
cttaaatttattcttgga

SEQ ID NO: 1362 - DNA, 19 bp, synthetic construct
  misc_feature 1..19: note = Description of sequence: CMP ID NO: 572_1
  source 1..19: mol_type = other DNA
  misc_feature 1..4: note = Backbone sugar is not deoxyribose
  misc_feature 18..19: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 18: mod_base = OTHER; note = beta-D-oxy-LNA thymine nucleoside
  modified_base 1: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
cttcttaaatttattcttg

SEQ ID NO: 1363 - DNA, 17 bp, synthetic construct
  misc_feature 1..17: note = Description of sequence: CMP ID NO: 573_1
  source 1..17: mol_type = other DNA
  misc_feature 1..4: note = Backbone sugar is not deoxyribose
  misc_feature 14..17: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 2: mod_base = OTHER; note = beta-D-oxy-LNA adenine nucleoside
  modified_base 14: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tatgtttctcagtaaag

SEQ ID NO: 1364 - DNA, 17 bp, synthetic construct
  misc_feature 1..17: note = Description of sequence: CMP ID NO: 574_1
  source 1..17: mol_type = other DNA
  misc_feature 1..3: note = Backbone sugar is not deoxyribose
  misc_feature 14..17: note = Backbone sugar is not deoxyribose
  modified_base 2: mod_base = OTHER; note = beta-D-oxy-LNA adenine nucleoside
  modified_base 3: mod_base = OTHER; note = beta-D-oxy-LNA adenine nucleoside
  modified_base 14: mod_base = OTHER; note = beta-D-oxy-LNA adenine nucleoside
  modified_base 17: mod_base = OTHER; note = beta-D-oxy-LNA adenine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
gaattatctttaaacca

SEQ ID NO: 1365 - DNA, 16 bp, synthetic construct
  misc_feature 1..16: note = Description of sequence: CMP ID NO: 575_1
  source 1..16: mol_type = other DNA
  misc_feature 1..3: note = Backbone sugar is not deoxyribose
  misc_feature 15..16: note = Backbone sugar is not deoxyribose
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cccttaaatttctaca

SEQ ID NO: 1366 - DNA, 16 bp, synthetic construct
  misc_feature 1..16: note = Description of sequence: CMP ID NO: 576_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA adenine nucleoside
  modified_base 3: mod_base = OTHER; note = beta-D-oxy-LNA adenine nucleoside
  modified_base 2: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acactgctcttgtacc

SEQ ID NO: 1367 - DNA, 16 bp, synthetic construct
  misc_feature 1..16: note = Description of sequence: CMP ID NO: 577_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgacaacactgctctt

SEQ ID NO: 1368 - DNA, 16 bp, synthetic construct
  misc_feature 1..16: note = Description of sequence: CMP ID NO: 578_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 3: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tacatttattgggctc

SEQ ID NO: 1369 - DNA, 16 bp, synthetic construct
  misc_feature 1..16: note = Description of sequence: CMP ID NO: 579_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtacatttattgggct

SEQ ID NO: 1370 - DNA, 16 bp, synthetic construct
  misc_feature 1..16: note = Description of sequence: CMP ID NO: 580_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 14: mod_base = OTHER; note = beta-D-oxy-LNA thymine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttggtacatttattgg

SEQ ID NO: 1371 - DNA, 17 bp, synthetic construct
  misc_feature 1..17: note = Description of sequence: CMP ID NO: 581_1
  source 1..17: mol_type = other DNA
  misc_feature 1..4: note = Backbone sugar is not deoxyribose
  misc_feature 15..17: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 17: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
catgttggtacatttat

SEQ ID NO: 1372 - DNA, 16 bp, synthetic construct
  misc_feature 1..16: note = Description of sequence: CMP ID NO: 582_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aatcatgttggtacat

SEQ ID NO: 1373 - DNA, 16 bp, synthetic construct
  misc_feature 1..16: note = Description of sequence: CMP ID NO: 583_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA adenine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aaatcatgttggtaca

SEQ ID NO: 1374 - DNA, 16 bp, synthetic construct
  misc_feature 1..16: note = Description of sequence: CMP ID NO: 584_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gacaagtttggattaa

SEQ ID NO: 1375 - DNA, 16 bp, synthetic construct
  misc_feature 1..16: note = Description of sequence: CMP ID NO: 585_1
  source 1..16: mol_type = other DNA
  misc_feature 1..2: note = Backbone sugar is not deoxyribose
  misc_feature 13..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 13: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aatgttcagatgcctc

SEQ ID NO: 1376 - DNA, 16 bp, synthetic construct
  misc_feature 1..16: note = Description of sequence: CMP ID NO: 586_1
  source 1..16: mol_type = other DNA
  misc_feature 1..2: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcttaatgttcagatg

SEQ ID NO: 1377 - DNA, 16 bp, synthetic construct
  misc_feature 1..16: note = Description of sequence: CMP ID NO: 587_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 4: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cgtacatagcttgatg

SEQ ID NO: 1378 - DNA, 16 bp, synthetic construct
  misc_feature 1..16: note = Description of sequence: CMP ID NO: 588_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtgaggaattaggata

SEQ ID NO: 1379 - DNA, 16 bp, synthetic construct
  misc_feature 1..16: note = Description of sequence: CMP ID NO: 589_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 3: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtaacaatatggtttg

SEQ ID NO: 1380 - DNA, 16 bp, synthetic construct
  misc_feature 1..16: note = Description of sequence: CMP ID NO: 590_1
  source 1..16: mol_type = other DNA
  misc_feature 1..2: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gaaatattgtagacta

SEQ ID NO: 1381 - DNA, 16 bp, synthetic construct
  misc_feature 1..16: note = Description of sequence: CMP ID NO: 591_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttgaaatattgtagac

SEQ ID NO: 1382 - DNA, 16 bp, synthetic construct
  misc_feature 1..16: note = Description of sequence: CMP ID NO: 592_1
  source 1..16: mol_type = other DNA
  misc_feature 1..2: note = Backbone sugar is not deoxyribose
  misc_feature 13..16: note = Backbone sugar is not deoxyribose
  modified_base 13: mod_base = OTHER; note = beta-D-oxy-LNA thymine nucleoside
  modified_base 14: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aagtctagtaatttgc

SEQ ID NO: 1383 - DNA, 16 bp, synthetic construct
  misc_feature 1..16: note = Description of sequence: CMP ID NO: 593_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gctcagtagattataa

SEQ ID NO: 1384 - DNA, 16 bp, synthetic construct
  misc_feature 1..16: note = Description of sequence: CMP ID NO: 594_1
  source 1..16: mol_type = other DNA
  misc_feature 1..3: note = Backbone sugar is not deoxyribose
  misc_feature 14..16: note = Backbone sugar is not deoxyribose
  modified_base 3: mod_base = OTHER; note = beta-D-oxy-LNA thymine nucleoside
  modified_base 14: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
catacactgttgctaa

SEQ ID NO: 1385 - DNA, 16 bp, synthetic construct
  misc_feature 1..16: note = Description of sequence: CMP ID NO: 595_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 14: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atggtctcaaatcatt

SEQ ID NO: 1386 - DNA, 16 bp, synthetic construct
  misc_feature 1..16: note = Description of sequence: CMP ID NO: 596_1
  source 1..16: mol_type = other DNA
  misc_feature 1..4: note = Backbone sugar is not deoxyribose
  misc_feature 15..16: note = Backbone sugar is not deoxyribose
  modified_base 4: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
caatggtctcaaatca

SEQ ID NO: 1387 - DNA, 16 bp, synthetic construct
  misc_feature 1..16: note = Description of sequence: CMP ID NO: 597_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttcctattgattgact

SEQ ID NO: 1388 - DNA, 16 bp, synthetic construct
  misc_feature 1..16: note = Description of sequence: CMP ID NO: 598_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA adenine nucleoside
  modified_base 4: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tttctgttcacaacac

SEQ ID NO: 1389 - DNA, 16 bp, synthetic construct
  misc_feature 1..16: note = Description of sequence: CMP ID NO: 599_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aggaacccactaatct

SEQ ID NO: 1390 - DNA, 16 bp, synthetic construct
  misc_feature 1..16: note = Description of sequence: CMP ID NO: 600_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
taaatggcaggaaccc

SEQ ID NO: 1391 - DNA, 16 bp, synthetic construct
  misc_feature 1..16: note = Description of sequence: CMP ID NO: 601_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtaaatggcaggaacc

SEQ ID NO: 1392 - DNA, 16 bp, synthetic construct
  misc_feature 1..16: note = Description of sequence: CMP ID NO: 602_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttgtaaatggcaggaa

SEQ ID NO: 1393 - DNA, 16 bp, synthetic construct
  misc_feature 1..16: note = Description of sequence: CMP ID NO: 603_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA thymine nucleoside
  modified_base 14: mod_base = OTHER; note = beta-D-oxy-LNA adenine nucleoside
  modified_base 13: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttatgagttaggcatg

SEQ ID NO: 1394 - DNA, 16 bp, synthetic construct
  misc_feature 1..16: note = Description of sequence: CMP ID NO: 604_1
  source 1..16: mol_type = other DNA
  misc_feature 1..3: note = Backbone sugar is not deoxyribose
  misc_feature 15..16: note = Backbone sugar is not deoxyribose
  modified_base 3: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ccaggtgaaactttaa

SEQ ID NO: 1395 - DNA, 16 bp, synthetic construct
  misc_feature 1..16: note = Description of sequence: CMP ID NO: 605_1
  source 1..16: mol_type = other DNA
  misc_feature 1..3: note = Backbone sugar is not deoxyribose
  misc_feature 14..16: note = Backbone sugar is not deoxyribose
  modified_base 16: mod_base = OTHER; note = beta-D-oxy-LNA thymine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cccttagtcagctcct

SEQ ID NO: 1396 - DNA, 16 bp, synthetic construct
  misc_feature 1..16: note = Description of sequence: CMP ID NO: 606_1
  source 1..16: mol_type = other DNA
  misc_feature 1..2: note = Backbone sugar is not deoxyribose
  misc_feature 13..16: note = Backbone sugar is not deoxyribose
  modified_base 14: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA 5-methyl cytosine nucleoside
  modified_base 13: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acccttagtcagctcc

SEQ ID NO: 1397 - DNA, 16 bp, synthetic construct
  misc_feature 1..16: note = Description of sequence: CMP ID NO: 607_1
  source 1..16: mol_type = other DNA
  misc_feature 1..2: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cacccttagtcagctc

SEQ ID NO: 1398 - DNA, 16 bp, synthetic construct
  misc_feature 1..16: note = Description of sequence: CMP ID NO: 608_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 14: mod_base = OTHER; note = beta-D-oxy-LNA thymine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tctcttactaggctcc

SEQ ID NO: 1399 - DNA, 16 bp, synthetic construct
  misc_feature 1..16: note = Description of sequence: CMP ID NO: 609_1
  source 1..16: mol_type = other DNA
  misc_feature 1..2: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 14: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cctatctgtcatcatg

SEQ ID NO: 1400 - DNA, 16 bp, synthetic construct
  misc_feature 1..16: note = Description of sequence: CMP ID NO: 610_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 15: mod_base = OTHER; note = beta-D-oxy-LNA adenine nucleoside
  modified_base 2: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcctatctgtcatcat

SEQ ID NO: 1401 - DNA, 16 bp, synthetic construct
  misc_feature 1..16: note = Description of sequence: CMP ID NO: 611_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gagaagtgtgagaagc

SEQ ID NO: 1402 - DNA, 16 bp, synthetic construct
  misc_feature 1..16: note = Description of sequence: CMP ID NO: 612_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
catccttgaagtttag

SEQ ID NO: 1403 - DNA, 16 bp, synthetic construct
  misc_feature 1..16: note = Description of sequence: CMP ID NO: 613_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
taataagatggctccc

SEQ ID NO: 1404 - DNA, 16 bp, synthetic construct
  misc_feature 1..16: note = Description of sequence: CMP ID NO: 614_1
  source 1..16: mol_type = other DNA
  misc_feature 1..3: note = Backbone sugar is not deoxyribose
  misc_feature 15..16: note = Backbone sugar is not deoxyribose
  modified_base 16: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
caaggcataataagat

SEQ ID NO: 1405 - DNA, 16 bp, synthetic construct
  misc_feature 1..16: note = Description of sequence: CMP ID NO: 615_1
  source 1..16: mol_type = other DNA
  misc_feature 1..2: note = Backbone sugar is not deoxyribose
  misc_feature 13..16: note = Backbone sugar is not deoxyribose
  modified_base 13: mod_base = OTHER; note = beta-D-oxy-LNA adenine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ccaaggcataataaga

SEQ ID NO: 1406 - DNA, 16 bp, synthetic construct
  misc_feature 1..16: note = Description of sequence: CMP ID NO: 616_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgatccaattctcacc

SEQ ID NO: 1407 - DNA, 16 bp, synthetic construct
  misc_feature 1..16: note = Description of sequence: CMP ID NO: 617_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA adenine nucleoside
  modified_base 14: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atgatccaattctcac

SEQ ID NO: 1408 - DNA, 16 bp, synthetic construct
  misc_feature 1..16: note = Description of sequence: CMP ID NO: 618_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cgcttcatcttcaccc

SEQ ID NO: 1409 - DNA, 16 bp, synthetic construct
  misc_feature 1..16: note = Description of sequence: CMP ID NO: 619_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 13: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tatgacactgcatctt

SEQ ID NO: 1410 - DNA, 16 bp, synthetic construct
  misc_feature 1..16: note = Description of sequence: CMP ID NO: 620_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtatgacactgcatct

SEQ ID NO: 1411 - DNA, 16 bp, synthetic construct
  misc_feature 1..16: note = Description of sequence: CMP ID NO: 621_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 14: mod_base = OTHER; note = beta-D-oxy-LNA adenine nucleoside
  modified_base 13: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgtatgacactgcatc

SEQ ID NO: 1412 - DNA, 16 bp, synthetic construct
  misc_feature 1..16: note = Description of sequence: CMP ID NO: 622_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 4: mod_base = OTHER; note = beta-D-oxy-LNA thymine nucleoside
  modified_base 15: mod_base = OTHER; note = beta-D-oxy-LNA thymine nucleoside
  modified_base 3: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttctcttctgtaagtc

SEQ ID NO: 1413 - DNA, 16 bp, synthetic construct
  misc_feature 1..16: note = Description of sequence: CMP ID NO: 623_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA thymine nucleoside
  modified_base 13: mod_base = OTHER; note = beta-D-oxy-LNA adenine nucleoside
  modified_base 16: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttctacagaggaacta

SEQ ID NO: 1414 - DNA, 16 bp, synthetic construct
  misc_feature 1..16: note = Description of sequence: CMP ID NO: 624_1
  source 1..16: mol_type = other DNA
  misc_feature 1..3: note = Backbone sugar is not deoxyribose
  misc_feature 14..16: note = Backbone sugar is not deoxyribose
  modified_base 3: mod_base = OTHER; note = beta-D-oxy-LNA thymine nucleoside
  modified_base 1: mod_base = OTHER; note = beta-D-oxy-LNA adenine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
actacagttctacaga

SEQ ID NO: 1415 - DNA, 16 bp, synthetic construct
  misc_feature 1..16: note = Description of sequence: CMP ID NO: 625_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 15: mod_base = OTHER; note = beta-D-oxy-LNA thymine nucleoside
  modified_base 3: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttcccacaggtaaatg

SEQ ID NO: 1416 - DNA, 20 bp, synthetic construct
  misc_feature 1..20: note = Description of sequence: CMP ID NO: 626_1
  source 1..20: mol_type = other DNA
  misc_feature 1..4: note = Backbone sugar is not deoxyribose
  misc_feature 17..20: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 19: mod_base = OTHER; note = beta-D-oxy-LNA thymine nucleoside
  modified_base 20: mod_base = OTHER; note = beta-D-oxy-LNA thymine nucleoside
  modified_base 1: mod_base = OTHER; note = beta-D-oxy-LNA adenine nucleoside
  modified_base 4: mod_base = OTHER; note = beta-D-oxy-LNA adenine nucleoside
  modified_base 18: mod_base = OTHER; note = beta-D-oxy-LNA adenine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
attatttgaatatactcatt

SEQ ID NO: 1417 - DNA, 17 bp, synthetic construct
  misc_feature 1..17: note = Description of sequence: CMP ID NO: 627_1
  source 1..17: mol_type = other DNA
  misc_feature 1..4: note = Backbone sugar is not deoxyribose
  misc_feature 15..17: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tgggaggaaattatttg

SEQ ID NO: 1418 - DNA, 16 bp, synthetic construct
  misc_feature 1..16: note = Description of sequence: CMP ID NO: 628_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 3: mod_base = OTHER; note = beta-D-oxy-LNA adenine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgactcatcttaaatg

SEQ ID NO: 1419 - DNA, 16 bp, synthetic construct
  misc_feature 1..16: note = Description of sequence: CMP ID NO: 629_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctgactcatcttaaat

SEQ ID NO: 1420 - DNA, 16 bp, synthetic construct
  misc_feature 1..16: note = Description of sequence: CMP ID NO: 630_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA thymine nucleoside
  modified_base 14: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tttactctgactcatc

SEQ ID NO: 1421 - DNA, 16 bp, synthetic construct
  misc_feature 1..16: note = Description of sequence: CMP ID NO: 631_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tattggaggaattatt

SEQ ID NO: 1422 - DNA, 16 bp, synthetic construct
  misc_feature 1..16: note = Description of sequence: CMP ID NO: 632_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtattggaggaattat

SEQ ID NO: 1423 - DNA, 20 bp, synthetic construct
  misc_feature 1..20: note = Description of sequence: CMP ID NO: 633_1
  source 1..20: mol_type = other DNA
  misc_feature 1..2: note = Backbone sugar is not deoxyribose
  misc_feature 18..20: note = Backbone sugar is not deoxyribose
  modified_base 1: mod_base = OTHER; note = beta-D-oxy-LNA thymine nucleoside
  modified_base 18: mod_base = OTHER; note = beta-D-oxy-LNA thymine nucleoside
  modified_base 20: mod_base = OTHER; note = beta-D-oxy-LNA thymine nucleoside
  modified_base 19: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
tggtatacttctctaagtat

SEQ ID NO: 1424 - DNA, 16 bp, synthetic construct
  misc_feature 1..16: note = Description of sequence: CMP ID NO: 634_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 4: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gatctcttggtatact

SEQ ID NO: 1425 - DNA, 16 bp, synthetic construct
  misc_feature 1..16: note = Description of sequence: CMP ID NO: 635_1
  source 1..16: mol_type = other DNA
  misc_feature 1..2: note = Backbone sugar is not deoxyribose
  misc_feature 15..16: note = Backbone sugar is not deoxyribose
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cagacaactctatacc

SEQ ID NO: 1426 - DNA, 17 bp, synthetic construct
  misc_feature 1..17: note = Description of sequence: CMP ID NO: 636_1
  source 1..17: mol_type = other DNA
  misc_feature 1..4: note = Backbone sugar is not deoxyribose
  misc_feature 14..17: note = Backbone sugar is not deoxyribose
  modified_base 14: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 4: mod_base = OTHER; note = beta-D-oxy-LNA adenine nucleoside
  modified_base 17: mod_base = OTHER; note = beta-D-oxy-LNA adenine nucleoside
  modified_base 3: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
aacatcagacaactcta

SEQ ID NO: 1427 - DNA, 16 bp, synthetic construct
  misc_feature 1..16: note = Description of sequence: CMP ID NO: 637_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 4: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
taacatcagacaactc

SEQ ID NO: 1428 - DNA, 18 bp, synthetic construct
  misc_feature 1..18: note = Description of sequence: CMP ID NO: 638_1
  source 1..18: mol_type = other DNA
  misc_feature 1..4: note = Backbone sugar is not deoxyribose
  misc_feature 15..18: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA thymine nucleoside
  modified_base 17: mod_base = OTHER; note = beta-D-oxy-LNA thymine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tttaacatcagacaactc

SEQ ID NO: 1429 - DNA, 16 bp, synthetic construct
  misc_feature 1..16: note = Description of sequence: CMP ID NO: 639_1
  source 1..16: mol_type = other DNA
  misc_feature 1..2: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atttaacatcagacaa

SEQ ID NO: 1430 - DNA, 17 bp, synthetic construct
  misc_feature 1..17: note = Description of sequence: CMP ID NO: 640_1
  source 1..17: mol_type = other DNA
  misc_feature 1..2: note = Backbone sugar is not deoxyribose
  misc_feature 14..17: note = Backbone sugar is not deoxyribose
  modified_base 14: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
cctatttaacatcagac

SEQ ID NO: 1431 - DNA, 16 bp, synthetic construct
  misc_feature 1..16: note = Description of sequence: CMP ID NO: 641_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tccctatttaacatca

SEQ ID NO: 1432 - DNA, 17 bp, synthetic construct
  misc_feature 1..17: note = Description of sequence: CMP ID NO: 642_1
  source 1..17: mol_type = other DNA
  misc_feature 1..4: note = Backbone sugar is not deoxyribose
  misc_feature 14..17: note = Backbone sugar is not deoxyribose
  modified_base 1: mod_base = OTHER; note = beta-D-oxy-LNA thymine nucleoside
  modified_base 17: mod_base = OTHER; note = beta-D-oxy-LNA thymine nucleoside
  modified_base 3: mod_base = OTHER; note = beta-D-oxy-LNA adenine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tcaacgactattggaat

SEQ ID NO: 1433 - DNA, 16 bp, synthetic construct
  misc_feature 1..16: note = Description of sequence: CMP ID NO: 643_1
  source 1..16: mol_type = other DNA
  misc_feature 1..4: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA thymine nucleoside
  modified_base 4: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cttatattctggctat

SEQ ID NO: 1434 - DNA, 16 bp, synthetic construct
  misc_feature 1..16: note = Description of sequence: CMP ID NO: 644_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atccttatattctggc

SEQ ID NO: 1435 - DNA, 16 bp, synthetic construct
  misc_feature 1..16: note = Description of sequence: CMP ID NO: 645_1
  source 1..16: mol_type = other DNA
  misc_feature 1..2: note = Backbone sugar is not deoxyribose
  misc_feature 13..16: note = Backbone sugar is not deoxyribose
  modified_base 14: mod_base = OTHER; note = beta-D-oxy-LNA thymine nucleoside
  modified_base 2: mod_base = OTHER; note = beta-D-oxy-LNA adenine nucleoside
  modified_base 13: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gatccttatattctgg

SEQ ID NO: 1436 - DNA, 16 bp, synthetic construct
  misc_feature 1..16: note = Description of sequence: CMP ID NO: 646_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 3: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgatccttatattctg

SEQ ID NO: 1437 - DNA, 16 bp, synthetic construct
  misc_feature 1..16: note = Description of sequence: CMP ID NO: 647_1
  source 1..16: mol_type = other DNA
  misc_feature 1..4: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 13: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
attgaaacttgatcct

SEQ ID NO: 1438 - DNA, 16 bp, synthetic construct
  misc_feature 1..16: note = Description of sequence: CMP ID NO: 648_1
  source 1..16: mol_type = other DNA
  misc_feature 1..2: note = Backbone sugar is not deoxyribose
  misc_feature 13..16: note = Backbone sugar is not deoxyribose
  modified_base 15: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 13: mod_base = OTHER; note = beta-D-oxy-LNA adenine nucleoside
  modified_base 2: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
actgtcattgaaactt

SEQ ID NO: 1439 - DNA, 16 bp, synthetic construct
  misc_feature 1..16: note = Description of sequence: CMP ID NO: 649_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcttactgtcattgaa

SEQ ID NO: 1440 - DNA, 17 bp, synthetic construct
  misc_feature 1..17: note = Description of sequence: CMP ID NO: 650_1
  source 1..17: mol_type = other DNA
  misc_feature 1..2: note = Backbone sugar is not deoxyribose
  misc_feature 14..17: note = Backbone sugar is not deoxyribose
  modified_base 16: mod_base = OTHER; note = beta-D-oxy-LNA thymine nucleoside
  modified_base 17: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
aggatcttactgtcatt

SEQ ID NO: 1441 - DNA, 16 bp, synthetic construct
  misc_feature 1..16: note = Description of sequence: CMP ID NO: 651_1
  source 1..16: mol_type = other DNA
  misc_feature 1..3: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 3: mod_base = OTHER; note = beta-D-oxy-LNA adenine nucleoside
  modified_base 14: mod_base = OTHER; note = beta-D-oxy-LNA adenine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gcaaatcaactccatc

SEQ ID NO: 1442 - DNA, 16 bp, synthetic construct
  misc_feature 1..16: note = Description of sequence: CMP ID NO: 652_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA adenine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtgcaaatcaactcca

SEQ ID NO: 1443 - DNA, 17 bp, synthetic construct
  misc_feature 1..17: note = Description of sequence: CMP ID NO: 653_1
  source 1..17: mol_type = other DNA
  misc_feature 1..4: note = Backbone sugar is not deoxyribose
  misc_feature 15..17: note = Backbone sugar is not deoxyribose
  modified_base 4: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 1: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
caattatttctttgtgc

SEQ ID NO: 1444 - DNA, 18 bp, synthetic construct
  misc_feature 1..18: note = Description of sequence: CMP ID NO: 654_1
  source 1..18: mol_type = other DNA
  misc_feature 1..3: note = Backbone sugar is not deoxyribose
  misc_feature 15..18: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 17: mod_base = OTHER; note = beta-D-oxy-LNA thymine nucleoside
  modified_base 18: mod_base = OTHER; note = beta-D-oxy-LNA thymine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
tggcaacaattatttctt

SEQ ID NO: 1445 - DNA, 16 bp, synthetic construct
  misc_feature 1..16: note = Description of sequence: CMP ID NO: 655_1
  source 1..16: mol_type = other DNA
  misc_feature 1..3: note = Backbone sugar is not deoxyribose
  misc_feature 13..16: note = Backbone sugar is not deoxyribose
  modified_base 3: mod_base = OTHER; note = beta-D-oxy-LNA thymine nucleoside
  modified_base 13: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 14: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gctggcaacaattatt

SEQ ID NO: 1446 - DNA, 16 bp, synthetic construct
  misc_feature 1..16: note = Description of sequence: CMP ID NO: 656_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atccatttctactgcc

SEQ ID NO: 1447 - DNA, 19 bp, synthetic construct
  misc_feature 1..19: note = Description of sequence: CMP ID NO: 657_1
  source 1..19: mol_type = other DNA
  misc_feature 1..4: note = Backbone sugar is not deoxyribose
  misc_feature 16..19: note = Backbone sugar is not deoxyribose
  modified_base 1: mod_base = OTHER; note = beta-D-oxy-LNA thymine nucleoside
  modified_base 4: mod_base = OTHER; note = beta-D-oxy-LNA thymine nucleoside
  modified_base 16: mod_base = OTHER; note = beta-D-oxy-LNA thymine nucleoside
  modified_base 18: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 19: mod_base = OTHER; note = beta-D-oxy-LNA adenine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
taatatctattgatttcta

SEQ ID NO: 1448 - DNA, 16 bp, synthetic construct
  misc_feature 1..16: note = Description of sequence: CMP ID NO: 658_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcaatagtgtagggca

SEQ ID NO: 1449 - DNA, 16 bp, synthetic construct
  misc_feature 1..16: note = Description of sequence: CMP ID NO: 659_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttcaatagtgtagggc

SEQ ID NO: 1450 - DNA, 19 bp, synthetic construct
  misc_feature 1..19: note = Description of sequence: CMP ID NO: 660_1
  source 1..19: mol_type = other DNA
  misc_feature 1..4: note = Backbone sugar is not deoxyribose
  misc_feature 16..19: note = Backbone sugar is not deoxyribose
  modified_base 4: mod_base = OTHER; note = beta-D-oxy-LNA thymine nucleoside
  modified_base 17: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  modified_base 18: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
aggttaattaattcaatag

SEQ ID NO: 1451 - DNA, 16 bp, synthetic construct
  misc_feature 1..16: note = Description of sequence: CMP ID NO: 661_2
  source 1..16: mol_type = other DNA
  misc_feature 1..3: note = Backbone sugar is not deoxyribose
  misc_feature 14..16: note = Backbone sugar is not deoxyribose
  modified_base 3: mod_base = OTHER; note = beta-D-oxy-LNA thymine nucleoside
  modified_base 14: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
catttgtaatccctag

SEQ ID NO: 1452 - DNA, 16 bp, synthetic construct
  misc_feature 1..16: note = Description of sequence: CMP ID NO: 661_1
  source 1..16: mol_type = other DNA
  misc_feature 1..3: note = Backbone sugar is not deoxyribose
  misc_feature 13..16: note = Backbone sugar is not deoxyribose
  modified_base 3: mod_base = OTHER; note = beta-D-oxy-LNA thymine nucleoside
  modified_base 14: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 13: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
catttgtaatccctag

SEQ ID NO: 1453 - DNA, 16 bp, synthetic construct
  misc_feature 1..16: note = Description of sequence: CMP ID NO: 662_1
  source 1..16: mol_type = other DNA
  misc_feature 1..3: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acatttgtaatcccta

SEQ ID NO: 1454 - DNA, 16 bp, synthetic construct
  misc_feature 1..16: note = Description of sequence: CMP ID NO: 663_2
  source 1..16: mol_type = other DNA
  misc_feature 1..2: note = Backbone sugar is not deoxyribose
  misc_feature 13..16: note = Backbone sugar is not deoxyribose
  modified_base 16: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 13: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aacatttgtaatccct

SEQ ID NO: 1455 - DNA, 16 bp, synthetic construct
  misc_feature 1..16: note = Description of sequence: CMP ID NO: 663_1
  source 1..16: mol_type = other DNA
  misc_feature 1..3: note = Backbone sugar is not deoxyribose
  misc_feature 13..16: note = Backbone sugar is not deoxyribose
  modified_base 16: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 3: mod_base = OTHER; note = beta-D-oxy-LNA 5-methyl cytosine nucleoside
  modified_base 13: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aacatttgtaatccct

SEQ ID NO: 1456 - DNA, 16 bp, synthetic construct
  misc_feature 1..16: note = Description of sequence: CMP ID NO: 664_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 2: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
taaatttcaagttctg

SEQ ID NO: 1457 - DNA, 18 bp, synthetic construct
  misc_feature 1..18: note = Description of sequence: CMP ID NO: 665_1
  source 1..18: mol_type = other DNA
  misc_feature 1..3: note = Backbone sugar is not deoxyribose
  misc_feature 15..18: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 18: mod_base = OTHER; note = beta-D-oxy-LNA thymine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
gtttaaatttcaagttct

SEQ ID NO: 1458 - DNA, 18 bp, synthetic construct
  misc_feature 1..18: note = Description of sequence: CMP ID NO: 666_1
  source 1..18: mol_type = other DNA
  misc_feature 1..4: note = Backbone sugar is not deoxyribose
  misc_feature 15..18: note = Backbone sugar is not deoxyribose
  modified_base 3: mod_base = OTHER; note = beta-D-oxy-LNA adenine nucleoside
  modified_base 4: mod_base = OTHER; note = beta-D-oxy-LNA adenine nucleoside
  modified_base 16: mod_base = OTHER; note = beta-D-oxy-LNA adenine nucleoside
  modified_base 17: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
ccaagtttaaatttcaag

SEQ ID NO: 1459 - DNA, 17 bp, synthetic construct
  misc_feature 1..17: note = Description of sequence: CMP ID NO: 667_1
  source 1..17: mol_type = other DNA
  misc_feature 1..4: note = Backbone sugar is not deoxyribose
  misc_feature 14..17: note = Backbone sugar is not deoxyribose
  modified_base 14: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
acccaagtttaaatttc

SEQ ID NO: 1460 - DNA, 19 bp, synthetic construct
  misc_feature 1..19: note = Description of sequence: CMP ID NO: 668_1
  source 1..19: mol_type = other DNA
  misc_feature 1..2: note = Backbone sugar is not deoxyribose
  misc_feature 17..19: note = Backbone sugar is not deoxyribose
  modified_base 17: mod_base = OTHER; note = beta-D-oxy-LNA thymine nucleoside
  modified_base 18: mod_base = OTHER; note = beta-D-oxy-LNA thymine nucleoside
  modified_base 19: mod_base = OTHER; note = beta-D-oxy-LNA thymine nucleoside
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
catacagtgacccaagttt

SEQ ID NO: 1461 - DNA, 16 bp, synthetic construct
  misc_feature 1..16: note = Description of sequence: CMP ID NO: 669_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acatcccatacagtga

SEQ ID NO: 1462 - DNA, 16 bp, synthetic construct
  misc_feature 1..16: note = Description of sequence: CMP ID NO: 670_1
  source 1..16: mol_type = other DNA
  misc_feature 1..2: note = Backbone sugar is not deoxyribose
  misc_feature 13..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 14: mod_base = OTHER; note = beta-D-oxy-LNA adenine nucleoside
  modified_base 13: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agcacagctctacatc

SEQ ID NO: 1463 - DNA, 16 bp, synthetic construct
  misc_feature 1..16: note = Description of sequence: CMP ID NO: 671_1
  source 1..16: mol_type = other DNA
  misc_feature 1..3: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 13: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 16: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atatagcacagctcta

SEQ ID NO: 1464 - DNA, 16 bp, synthetic construct
  misc_feature 1..16: note = Description of sequence: CMP ID NO: 672_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tccatatagcacagct

SEQ ID NO: 1465 - DNA, 16 bp, synthetic construct
  misc_feature 1..16: note = Description of sequence: CMP ID NO: 673_1
  source 1..16: mol_type = other DNA
  misc_feature 1..3: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 1: mod_base = OTHER; note = beta-D-oxy-LNA adenine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  modified_base 13: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atttccatatagcaca

SEQ ID NO: 1466 - DNA, 17 bp, synthetic construct
  misc_feature 1..17: note = Description of sequence: CMP ID NO: 674_1
  source 1..17: mol_type = other DNA
  misc_feature 1..4: note = Backbone sugar is not deoxyribose
  misc_feature 14..17: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA thymine nucleoside
  modified_base 4: mod_base = OTHER; note = beta-D-oxy-LNA adenine nucleoside
  modified_base 14: mod_base = OTHER; note = beta-D-oxy-LNA adenine nucleoside
  modified_base 17: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
tttatttccatatagca

SEQ ID NO: 1467 - DNA, 16 bp, synthetic construct
  misc_feature 1..16: note = Description of sequence: CMP ID NO: 675_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA thymine nucleoside
  modified_base 14: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tttatttccatatagc

SEQ ID NO: 1468 - DNA, 17 bp, synthetic construct
  misc_feature 1..17: note = Description of sequence: CMP ID NO: 676_1
  source 1..17: mol_type = other DNA
  misc_feature 1..4: note = Backbone sugar is not deoxyribose
  misc_feature 14..17: note = Backbone sugar is not deoxyribose
  modified_base 14: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
aaggagaggagattatg

SEQ ID NO: 1469 - DNA, 16 bp, synthetic construct
  misc_feature 1..16: note = Description of sequence: CMP ID NO: 677_1
  source 1..16: mol_type = other DNA
  misc_feature 1..3: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agttcttgtgttagct

SEQ ID NO: 1470 - DNA, 16 bp, synthetic construct
  misc_feature 1..16: note = Description of sequence: CMP ID NO: 678_1
  source 1..16: mol_type = other DNA
  misc_feature 1..2: note = Backbone sugar is not deoxyribose
  misc_feature 15..16: note = Backbone sugar is not deoxyribose
  modified_base 2: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gagttcttgtgttagc

SEQ ID NO: 1471 - DNA, 17 bp, synthetic construct
  misc_feature 1..17: note = Description of sequence: CMP ID NO: 679_1
  source 1..17: mol_type = other DNA
  misc_feature 1..3: note = Backbone sugar is not deoxyribose
  misc_feature 14..17: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
attaattatccatccac

SEQ ID NO: 1472 - DNA, 18 bp, synthetic construct
  misc_feature 1..18: note = Description of sequence: CMP ID NO: 680_1
  source 1..18: mol_type = other DNA
  misc_feature 1..3: note = Backbone sugar is not deoxyribose
  misc_feature 15..18: note = Backbone sugar is not deoxyribose
  modified_base 2: mod_base = OTHER; note = beta-D-oxy-LNA thymine nucleoside
  modified_base 17: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA adenine nucleoside
  modified_base 3: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
atcaattaattatccatc

SEQ ID NO: 1473 - DNA, 18 bp, synthetic construct
  misc_feature 1..18: note = Description of sequence: CMP ID NO: 681_1
  source 1..18: mol_type = other DNA
  misc_feature 1..3: note = Backbone sugar is not deoxyribose
  misc_feature 16..18: note = Backbone sugar is not deoxyribose
  modified_base 16: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 17: mod_base = OTHER; note = beta-D-oxy-LNA 5-methyl cytosine nucleoside
  modified_base 18: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
agaatcaattaattatcc

SEQ ID NO: 1474 - DNA, 16 bp, synthetic construct
  misc_feature 1..16: note = Description of sequence: CMP ID NO: 682_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgagataccgtgcatg

SEQ ID NO: 1475 - DNA, 16 bp, synthetic construct
  misc_feature 1..16: note = Description of sequence: CMP ID NO: 683_1
  source 1..16: mol_type = other DNA
  misc_feature 1..2: note = Backbone sugar is not deoxyribose
  misc_feature 13..16: note = Backbone sugar is not deoxyribose
  modified_base 13: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aatgagataccgtgca

SEQ ID NO: 1476 - DNA, 16 bp, synthetic construct
  misc_feature 1..16: note = Description of sequence: CMP ID NO: 684_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 16: mod_base = OTHER; note = beta-D-oxy-LNA thymine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctgtggttaggctaat

SEQ ID NO: 1477 - DNA, 20 bp, synthetic construct
  misc_feature 1..20: note = Description of sequence: CMP ID NO: 685_1
  source 1..20: mol_type = other DNA
  misc_feature 1: note = Backbone sugar is not deoxyribose
  misc_feature 19..20: note = Backbone sugar is not deoxyribose
  modified_base 19: mod_base = OTHER; note = beta-D-oxy-LNA thymine nucleoside
  modified_base 20: mod_base = OTHER; note = beta-D-oxy-LNA thymine nucleoside
  modified_base 1: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
aagagtaagggtctgtggtt

SEQ ID NO: 1478 - DNA, 16 bp, synthetic construct
  misc_feature 1..16: note = Description of sequence: CMP ID NO: 686_1
  source 1..16: mol_type = other DNA
  misc_feature 1..4: note = Backbone sugar is not deoxyribose
  misc_feature 14..16: note = Backbone sugar is not deoxyribose
  modified_base 3: mod_base = OTHER; note = beta-D-oxy-LNA thymine nucleoside
  modified_base 14: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gatgggttaagagtaa

SEQ ID NO: 1479 - DNA, 16 bp, synthetic construct
  misc_feature 1..16: note = Description of sequence: CMP ID NO: 687_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA adenine nucleoside
  modified_base 16: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agcagatgggttaaga

SEQ ID NO: 1480 - DNA, 16 bp, synthetic construct
  misc_feature 1..16: note = Description of sequence: CMP ID NO: 688_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 13: mod_base = OTHER; note = beta-D-oxy-LNA thymine nucleoside
  modified_base 14: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgtaaacatttgtagc

SEQ ID NO: 1481 - DNA, 16 bp, synthetic construct
  misc_feature 1..16: note = Description of sequence: CMP ID NO: 689_1
  source 1..16: mol_type = other DNA
  misc_feature 1..3: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cctgcttataaatgta

SEQ ID NO: 1482 - DNA, 16 bp, synthetic construct
  misc_feature 1..16: note = Description of sequence: CMP ID NO: 690_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 15: mod_base = OTHER; note = beta-D-oxy-LNA adenine nucleoside
  modified_base 3: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgccctgcttataaat

SEQ ID NO: 1483 - DNA, 16 bp, synthetic construct
  misc_feature 1..16: note = Description of sequence: CMP ID NO: 691_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcttcttagttcaata

SEQ ID NO: 1484 - DNA, 16 bp, synthetic construct
  misc_feature 1..16: note = Description of sequence: CMP ID NO: 692_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 13: mod_base = OTHER; note = beta-D-oxy-LNA adenine nucleoside
  modified_base 15: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tggtttctaactacat

SEQ ID NO: 1485 - DNA, 17 bp, synthetic construct
  misc_feature 1..17: note = Description of sequence: CMP ID NO: 693_1
  source 1..17: mol_type = other DNA
  misc_feature 1..2: note = Backbone sugar is not deoxyribose
  misc_feature 15..17: note = Backbone sugar is not deoxyribose
  modified_base 16: mod_base = OTHER; note = beta-D-oxy-LNA thymine nucleoside
  modified_base 1: mod_base = OTHER; note = beta-D-oxy-LNA adenine nucleoside
  modified_base 17: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
agtttggtttctaacta

SEQ ID NO: 1486 - DNA, 16 bp, synthetic construct
  misc_feature 1..16: note = Description of sequence: CMP ID NO: 694_1
  source 1..16: mol_type = other DNA
  misc_feature 1..3: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gaatgaaacttgcctg

SEQ ID NO: 1487 - DNA, 16 bp, synthetic construct
  misc_feature 1..16: note = Description of sequence: CMP ID NO: 695_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
attatccttacatgat

SEQ ID NO: 1488 - DNA, 16 bp, synthetic construct
  misc_feature 1..16: note = Description of sequence: CMP ID NO: 696_1
  source 1..16: mol_type = other DNA
  misc_feature 1..2: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtacccaattatcctt

SEQ ID NO: 1489 - DNA, 16 bp, synthetic construct
  misc_feature 1..16: note = Description of sequence: CMP ID NO: 697_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 16: mod_base = OTHER; note = beta-D-oxy-LNA thymine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgtacccaattatcct

SEQ ID NO: 1490 - DNA, 16 bp, synthetic construct
  misc_feature 1..16: note = Description of sequence: CMP ID NO: 698_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttgtacccaattatcc

SEQ ID NO: 1491 - DNA, 16 bp, synthetic construct
  misc_feature 1..16: note = Description of sequence: CMP ID NO: 699_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tttgtacccaattatc

SEQ ID NO: 1492 - DNA, 16 bp, synthetic construct
  misc_feature 1..16: note = Description of sequence: CMP ID NO: 700_1
  source 1..16: mol_type = other DNA
  misc_feature 1..4: note = Backbone sugar is not deoxyribose
  misc_feature 15..16: note = Backbone sugar is not deoxyribose
  modified_base 15: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 4: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agcagcaggttatatt

SEQ ID NO: 1493 - DNA, 16 bp, synthetic construct
  misc_feature 1..16: note = Description of sequence: CMP ID NO: 701_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgggaagtggtctggg

SEQ ID NO: 1494 - DNA, 16 bp, synthetic construct
  misc_feature 1..16: note = Description of sequence: CMP ID NO: 702_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctggagagtgataata

SEQ ID NO: 1495 - DNA, 16 bp, synthetic construct
  misc_feature 1..16: note = Description of sequence: CMP ID NO: 703_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aatgctggattacgtc

SEQ ID NO: 1496 - DNA, 16 bp, synthetic construct
  misc_feature 1..16: note = Description of sequence: CMP ID NO: 704_1
  source 1..16: mol_type = other DNA
  misc_feature 1..2: note = Backbone sugar is not deoxyribose
  misc_feature 14..16: note = Backbone sugar is not deoxyribose
  modified_base 16: mod_base = OTHER; note = beta-D-oxy-LNA thymine nucleoside
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
caatgctggattacgt

SEQ ID NO: 1497 - DNA, 16 bp, synthetic construct
  misc_feature 1..16: note = Description of sequence: CMP ID NO: 705_1
  source 1..16: mol_type = other DNA
  misc_feature 1..2: note = Backbone sugar is not deoxyribose
  misc_feature 13..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 14: mod_base = OTHER; note = beta-D-oxy-LNA thymine nucleoside
  modified_base 13: mod_base = OTHER; note = beta-D-oxy-LNA adenine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttgttcagaagtatcc

SEQ ID NO: 1498 - DNA, 16 bp, synthetic construct
  misc_feature 1..16: note = Description of sequence: CMP ID NO: 706_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gatgatttgcttggag

SEQ ID NO: 1499 - DNA, 16 bp, synthetic construct
  misc_feature 1..16: note = Description of sequence: CMP ID NO: 707_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA adenine nucleoside
  modified_base 3: mod_base = OTHER; note = beta-D-oxy-LNA adenine nucleoside
  modified_base 14: mod_base = OTHER; note = beta-D-oxy-LNA adenine nucleoside
  modified_base 15: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gaaatcattcacaacc

SEQ ID NO: 1500 - DNA, 16 bp, synthetic construct
  misc_feature 1..16: note = Description of sequence: CMP ID NO: 708_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttgtaacatctactac

SEQ ID NO: 1501 - DNA, 16 bp, synthetic construct
  misc_feature 1..16: note = Description of sequence: CMP ID NO: 709_1
  source 1..16: mol_type = other DNA
  misc_feature 1..3: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cattaagcagcaagtt

SEQ ID NO: 1502 - DNA, 16 bp, synthetic construct
  misc_feature 1..16: note = Description of sequence: CMP ID NO: 710_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 3: mod_base = OTHER; note = beta-D-oxy-LNA adenine nucleoside
  modified_base 16: mod_base = OTHER; note = beta-D-oxy-LNA adenine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ttactagatgtgagca

SEQ ID NO: 1503 - DNA, 16 bp, synthetic construct
  misc_feature 1..16: note = Description of sequence: CMP ID NO: 711_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 2: mod_base = OTHER; note = beta-D-oxy-LNA thymine nucleoside
  modified_base 14: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tttactagatgtgagc

SEQ ID NO: 1504 - DNA, 16 bp, synthetic construct
  misc_feature 1..16: note = Description of sequence: CMP ID NO: 712_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA adenine nucleoside
  modified_base 16: mod_base = OTHER; note = beta-D-oxy-LNA adenine nucleoside
  modified_base 3: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gaccaagcaccttaca

SEQ ID NO: 1505 - DNA, 16 bp, synthetic construct
  misc_feature 1..16: note = Description of sequence: CMP ID NO: 713_1
  source 1..16: mol_type = other DNA
  misc_feature 1..3: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agaccaagcaccttac

SEQ ID NO: 1506 - DNA, 16 bp, synthetic construct
  misc_feature 1..16: note = Description of sequence: CMP ID NO: 714_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 1: mod_base = OTHER; note = beta-D-oxy-LNA adenine nucleoside
  modified_base 13: mod_base = OTHER; note = beta-D-oxy-LNA adenine nucleoside
  modified_base 14: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
atgggttaaataaagg

SEQ ID NO: 1507 - DNA, 16 bp, synthetic construct
  misc_feature 1..16: note = Description of sequence: CMP ID NO: 715_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcaaccagagtattaa

SEQ ID NO: 1508 - DNA, 16 bp, synthetic construct
  misc_feature 1..16: note = Description of sequence: CMP ID NO: 716_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtcaaccagagtatta

SEQ ID NO: 1509 - DNA, 16 bp, synthetic construct
  misc_feature 1..16: note = Description of sequence: CMP ID NO: 717_1
  source 1..16: mol_type = other DNA
  misc_feature 1..2: note = Backbone sugar is not deoxyribose
  misc_feature 14..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
attgtaaagctgatat

SEQ ID NO: 1510 - DNA, 16 bp, synthetic construct
  misc_feature 1..16: note = Description of sequence: CMP ID NO: 718_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA adenine nucleoside
  modified_base 13: mod_base = OTHER; note = beta-D-oxy-LNA adenine nucleoside
  modified_base 14: mod_base = OTHER; note = beta-D-oxy-LNA adenine nucleoside
  modified_base 1: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cacataattgtaaagc

SEQ ID NO: 1511 - DNA, 16 bp, synthetic construct
  misc_feature 1..16: note = Description of sequence: CMP ID NO: 719_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gaggtctgctatttac

SEQ ID NO: 1512 - DNA, 16 bp, synthetic construct
  misc_feature 1..16: note = Description of sequence: CMP ID NO: 720_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 16: mod_base = OTHER; note = beta-D-oxy-LNA thymine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgtagattcaatgcct

SEQ ID NO: 1513 - DNA, 16 bp, synthetic construct
  misc_feature 1..16: note = Description of sequence: CMP ID NO: 721_1
  source 1..16: mol_type = other DNA
  misc_feature 1..2: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cctcattatactatga

SEQ ID NO: 1514 - DNA, 16 bp, synthetic construct
  misc_feature 1..16: note = Description of sequence: CMP ID NO: 722_1
  source 1..16: mol_type = other DNA
  misc_feature 1..2: note = Backbone sugar is not deoxyribose
  misc_feature 15..16: note = Backbone sugar is not deoxyribose
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ccttatgctatgacac

SEQ ID NO: 1515 - DNA, 16 bp, synthetic construct
  misc_feature 1..16: note = Description of sequence: CMP ID NO: 723_1
  source 1..16: mol_type = other DNA
  misc_feature 1..4: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 4: mod_base = OTHER; note = beta-D-oxy-LNA thymine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tccttatgctatgaca

SEQ ID NO: 1516 - DNA, 16 bp, synthetic construct
  misc_feature 1..16: note = Description of sequence: CMP ID NO: 724_1
  source 1..16: mol_type = other DNA
  misc_feature 1..3: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 14: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aagatgtttaagtata

SEQ ID NO: 1517 - DNA, 16 bp, synthetic construct
  misc_feature 1..16: note = Description of sequence: CMP ID NO: 725_1
  source 1..16: mol_type = other DNA
  misc_feature 1..2: note = Backbone sugar is not deoxyribose
  misc_feature 13..16: note = Backbone sugar is not deoxyribose
  modified_base 2: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA thymine nucleoside
  modified_base 13: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctgattattaagatgt

SEQ ID NO: 1518 - DNA, 16 bp, synthetic construct
  misc_feature 1..16: note = Description of sequence: CMP ID NO: 726_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tggaaaggtatgaatt

SEQ ID NO: 1519 - DNA, 16 bp, synthetic construct
  misc_feature 1..16: note = Description of sequence: CMP ID NO: 727_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA adenine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acttgaatggcttgga

SEQ ID NO: 1520 - DNA, 16 bp, synthetic construct
  misc_feature 1..16: note = Description of sequence: CMP ID NO: 728_1
  source 1..16: mol_type = other DNA
  misc_feature 1..3: note = Backbone sugar is not deoxyribose
  misc_feature 14..16: note = Backbone sugar is not deoxyribose
  modified_base 14: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aacttgaatggcttgg

SEQ ID NO: 1521 - DNA, 16 bp, synthetic construct
  misc_feature 1..16: note = Description of sequence: CMP ID NO: 729_1
  source 1..16: mol_type = other DNA
  misc_feature 1..4: note = Backbone sugar is not deoxyribose
  misc_feature 15..16: note = Backbone sugar is not deoxyribose
  modified_base 4: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 2: mod_base = OTHER; note = beta-D-oxy-LNA adenine nucleoside
  modified_base 3: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
caatgtgttactattt

SEQ ID NO: 1522 - DNA, 16 bp, synthetic construct
  misc_feature 1..16: note = Description of sequence: CMP ID NO: 730_1
  source 1..16: mol_type = other DNA
  misc_feature 1..3: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 16: mod_base = OTHER; note = beta-D-oxy-LNA thymine nucleoside
  modified_base 1: mod_base = OTHER; note = beta-D-oxy-LNA adenine nucleoside
  modified_base 3: mod_base = OTHER; note = beta-D-oxy-LNA adenine nucleoside
  modified_base 14: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acaatgtgttactatt

SEQ ID NO: 1523 - DNA, 16 bp, synthetic construct
  misc_feature 1..16: note = Description of sequence: CMP ID NO: 731_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 2: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
catctgctatataaga

SEQ ID NO: 1524 - DNA, 16 bp, synthetic construct
  misc_feature 1..16: note = Description of sequence: CMP ID NO: 732_1
  source 1..16: mol_type = other DNA
  misc_feature 1..4: note = Backbone sugar is not deoxyribose
  misc_feature 15..16: note = Backbone sugar is not deoxyribose
  modified_base 3: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  modified_base 4: mod_base = OTHER; note = beta-D-oxy-LNA adenine nucleoside
  modified_base 1: mod_base = OTHER; note = beta-D-oxy-LNA 5-methyl cytosine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cctagagcaaatactt

SEQ ID NO: 1525 - DNA, 16 bp, synthetic construct
  misc_feature 1..16: note = Description of sequence: CMP ID NO: 733_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA adenine nucleoside
  modified_base 14: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cagagttaataataag

SEQ ID NO: 1526 - DNA, 16 bp, synthetic construct
  misc_feature 1..16: note = Description of sequence: CMP ID NO: 734_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 3: mod_base = OTHER; note = beta-D-oxy-LNA thymine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  modified_base 4: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gttcaagcacaacgaa

SEQ ID NO: 1527 - DNA, 16 bp, synthetic construct
  misc_feature 1..16: note = Description of sequence: CMP ID NO: 735_1
  source 1..16: mol_type = other DNA
  misc_feature 1..2: note = Backbone sugar is not deoxyribose
  misc_feature 14..16: note = Backbone sugar is not deoxyribose
  modified_base 1: mod_base = OTHER; note = beta-D-oxy-LNA adenine nucleoside
  modified_base 14: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agggttcaagcacaac

SEQ ID NO: 1528 - DNA, 16 bp, synthetic construct
  misc_feature 1..16: note = Description of sequence: CMP ID NO: 736_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA thymine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgttggagacactgtt

SEQ ID NO: 1529 - DNA, 16 bp, synthetic construct
  misc_feature 1..16: note = Description of sequence: CMP ID NO: 737_1
  source 1..16: mol_type = other DNA
  misc_feature 1..3: note = Backbone sugar is not deoxyribose
  misc_feature 15..16: note = Backbone sugar is not deoxyribose
  modified_base 1: mod_base = OTHER; note = beta-D-oxy-LNA adenine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aaggaggagttaggac

SEQ ID NO: 1530 - DNA, 16 bp, synthetic construct
  misc_feature 1..16: note = Description of sequence: CMP ID NO: 738_1
  source 1..16: mol_type = other DNA
  misc_feature 1..4: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 4: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  modified_base 1: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
ctatgccatttacgat

SEQ ID NO: 1531 - DNA, 16 bp, synthetic construct
  misc_feature 1..16: note = Description of sequence: CMP ID NO: 739_1
  source 1..16: mol_type = other DNA
  misc_feature 1..2: note = Backbone sugar is not deoxyribose
  misc_feature 15..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcaaatgcagaattag

SEQ ID NO: 1532 - DNA, 16 bp, synthetic construct
  misc_feature 1..16: note = Description of sequence: CMP ID NO: 740_1
  source 1..16: mol_type = other DNA
  misc_feature 1..2: note = Backbone sugar is not deoxyribose
  misc_feature 13..16: note = Backbone sugar is not deoxyribose
  modified_base 14: mod_base = OTHER; note = beta-D-oxy-LNA thymine nucleoside
  modified_base 1: mod_base = OTHER; note = beta-D-oxy-LNA adenine nucleoside
  modified_base 13: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agtgacaatcaaatgc

SEQ ID NO: 1533 - DNA, 16 bp, synthetic construct
  misc_feature 1..16: note = Description of sequence: CMP ID NO: 741_1
  source 1..16: mol_type = other DNA
  misc_feature 1..2: note = Backbone sugar is not deoxyribose
  misc_feature 14..16: note = Backbone sugar is not deoxyribose
  modified_base 15: mod_base = OTHER; note = beta-D-oxy-LNA thymine nucleoside
  modified_base 1: mod_base = OTHER; note = beta-D-oxy-LNA adenine nucleoside
  modified_base 2: mod_base = OTHER; note = beta-D-oxy-LNA adenine nucleoside
  modified_base 14: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
aagtgacaatcaaatg

SEQ ID NO: 1534 - DNA, 16 bp, synthetic construct
  misc_feature 1..16: note = Description of sequence: CMP ID NO: 742_1
  source 1..16: mol_type = other DNA
  misc_feature 1..3: note = Backbone sugar is not deoxyribose
  misc_feature 15..16: note = Backbone sugar is not deoxyribose
  modified_base 2: mod_base = OTHER; note = beta-D-oxy-LNA thymine nucleoside
  modified_base 15: mod_base = OTHER; note = beta-D-oxy-LNA adenine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gtgtaccaagtaacaa

SEQ ID NO: 1535 - DNA, 16 bp, synthetic construct
  misc_feature 1..16: note = Description of sequence: CMP ID NO: 743_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgggatgttaaactga

SEQ ID NO: 1536 - DNA, 16 bp, synthetic construct
  misc_feature 1..16: note = Description of sequence: CMP ID NO: 744_1
  source 1..16: mol_type = other DNA
  misc_feature 1..3: note = Backbone sugar is not deoxyribose
  misc_feature 14..16: note = Backbone sugar is not deoxyribose
  modified_base 3: mod_base = OTHER; note = beta-D-oxy-LNA thymine nucleoside
  modified_base 14: mod_base = OTHER; note = beta-D-oxy-LNA thymine nucleoside
  modified_base 1: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
agtttacattttctgc

SEQ ID NO: 1537 - DNA, 16 bp, synthetic construct
  misc_feature 1..16: note = Description of sequence: CMP ID NO: 745_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 3: mod_base = OTHER; note = beta-D-oxy-LNA thymine nucleoside
  modified_base 2: mod_base = OTHER; note = beta-D-oxy-LNA adenine nucleoside
  modified_base 15: mod_base = OTHER; note = beta-D-oxy-LNA adenine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tatgtgaagaggagag

SEQ ID NO: 1538 - DNA, 16 bp, synthetic construct
  misc_feature 1..16: note = Description of sequence: CMP ID NO: 746_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA adenine nucleoside
  modified_base 16: mod_base = OTHER; note = beta-D-oxy-LNA adenine nucleoside
  modified_base 1: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cacctttaaaacccca

SEQ ID NO: 1539 - DNA, 16 bp, synthetic construct
  misc_feature 1..16: note = Description of sequence: CMP ID NO: 747_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA adenine nucleoside
  modified_base 2: mod_base = OTHER; note = beta-D-oxy-LNA 5-methyl cytosine nucleoside
  modified_base 3: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcctttataatcacac

SEQ ID NO: 1540 - DNA, 16 bp, synthetic construct
  misc_feature 1..16: note = Description of sequence: CMP ID NO: 748_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA adenine nucleoside
  modified_base 14: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
acggtattttcacagg

SEQ ID NO: 1541 - DNA, 16 bp, synthetic construct
  misc_feature 1..16: note = Description of sequence: CMP ID NO: 749_1
  source 1..16: mol_type = other DNA
  misc_feature 1..3: note = Backbone sugar is not deoxyribose
  misc_feature 14..16: note = Backbone sugar is not deoxyribose
  modified_base 2: mod_base = OTHER; note = beta-D-oxy-LNA adenine nucleoside
  modified_base 16: mod_base = OTHER; note = beta-D-oxy-LNA adenine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
gacactacaatgagga

SEQ ID NO: 1542 - DNA, 16 bp, synthetic construct
  misc_feature 1..16: note = Description of sequence: CMP ID NO: 750_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  modified_base 16: mod_base = OTHER; note = beta-D-oxy-LNA thymine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tggtttttaggactgt

SEQ ID NO: 1543 - DNA, 16 bp, synthetic construct
  misc_feature 1..16: note = Description of sequence: CMP ID NO: 751_1
  source 1..16: mol_type = other DNA
  misc_feature 1..3: note = Backbone sugar is not deoxyribose
  misc_feature 14..16: note = Backbone sugar is not deoxyribose
  modified_base 16: mod_base = OTHER; note = beta-D-oxy-LNA thymine nucleoside
  modified_base 3: mod_base = OTHER; note = beta-D-oxy-LNA adenine nucleoside
  modified_base 1: mod_base = OTHER; note = beta-D-oxy-LNA 5-methyl cytosine nucleoside
  modified_base 14: mod_base = OTHER; note = beta-D-oxy-LNA 5-methyl cytosine nucleoside
  modified_base 15: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cgacaaattctatcct

SEQ ID NO: 1544 - DNA, 16 bp, synthetic construct
  misc_feature 1..16: note = Description of sequence: CMP ID NO: 752_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  modified_base 3: mod_base = OTHER; note = beta-D-oxy-LNA adenine nucleoside
  modified_base 15: mod_base = OTHER; note = beta-D-oxy-LNA adenine nucleoside
  modified_base 16: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgatatacaatgctac

SEQ ID NO: 1545 - DNA, 16 bp, synthetic construct
  misc_feature 1..16: note = Description of sequence: CMP ID NO: 753_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 14: mod_base = OTHER; note = beta-D-oxy-LNA thymine nucleoside
  modified_base 15: mod_base = OTHER; note = beta-D-oxy-LNA thymine nucleoside
  modified_base 16: mod_base = OTHER; note = beta-D-oxy-LNA adenine nucleoside
  modified_base 2: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tcgttgggtaaattta

SEQ ID NO: 1546 - DNA, 16 bp, synthetic construct
  misc_feature 1..16: note = Description of sequence: CMP ID NO: 754_1
  source 1..16: mol_type = other DNA
  misc_feature 1..3: note = Backbone sugar is not deoxyribose
  misc_feature 14..16: note = Backbone sugar is not deoxyribose
  modified_base 1: mod_base = OTHER; note = beta-D-oxy-LNA thymine nucleoside
  modified_base 15: mod_base = OTHER; note = beta-D-oxy-LNA thymine nucleoside
  modified_base 3: mod_base = OTHER; note = beta-D-oxy-LNA 5-methyl cytosine nucleoside
  misc_feature 1^2: note = phosphorothioate internucleoside linkage
  misc_feature 2^3: note = phosphorothioate internucleoside linkage
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
tgctttataaatggtg

SEQ ID NO: 1547 - DNA, 18 bp, synthetic construct
  misc_feature 1..18: note = Description of sequence: CMP ID NO: 755_1
  source 1..18: mol_type = other DNA
  misc_feature 3..7: note = Backbone sugar is not deoxyribose
  misc_feature 16..18: note = Backbone sugar is not deoxyribose
  modified_base 5: mod_base = OTHER; note = beta-D-oxy-LNA thymine nucleoside
  modified_base 16: mod_base = OTHER; note = beta-D-oxy-LNA thymine nucleoside
  modified_base 3: mod_base = OTHER; note = beta-D-oxy-LNA adenine nucleoside
  modified_base 18: mod_base = OTHER; note = beta-D-oxy-LNA 5-methyl cytosine nucleoside
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
caagtttacattttctgc

SEQ ID NO: 1548 - DNA, 18 bp, synthetic construct
  misc_feature 1..18: note = Description of sequence: CMP ID NO: 756_1
  source 1..18: mol_type = other DNA
  misc_feature 3..7: note = Backbone sugar is not deoxyribose
  misc_feature 16..18: note = Backbone sugar is not deoxyribose
  modified_base 3: mod_base = OTHER; note = beta-D-oxy-LNA thymine nucleoside
  modified_base 5: mod_base = OTHER; note = beta-D-oxy-LNA thymine nucleoside
  modified_base 4: mod_base = OTHER; note = beta-D-oxy-LNA adenine nucleoside
  modified_base 17: mod_base = OTHER; note = beta-D-oxy-LNA adenine nucleoside
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
catatgtgaagaggagag

SEQ ID NO: 1549 - DNA, 16 bp, synthetic construct
  misc_feature 1..16: note = Description of sequence: CMP ID NO: 757_1
  source 1..16: mol_type = other DNA
  misc_feature 3..7: note = Backbone sugar is not deoxyribose
  misc_feature 14..16: note = Backbone sugar is not deoxyribose
  modified_base 4: mod_base = OTHER; note = beta-D-oxy-LNA adenine nucleoside
  modified_base 3: mod_base = OTHER; note = beta-D-oxy-LNA 5-methyl cytosine nucleoside
  modified_base 5: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
cacctttaaaacccca

SEQ ID NO: 1550 - DNA, 18 bp, synthetic construct
  misc_feature 1..18: note = Description of sequence: CMP ID NO: 758_1
  source 1..18: mol_type = other DNA
  misc_feature 3..7: note = Backbone sugar is not deoxyribose
  misc_feature 16..18: note = Backbone sugar is not deoxyribose
  modified_base 3: mod_base = OTHER; note = beta-D-oxy-LNA thymine nucleoside
  modified_base 17: mod_base = OTHER; note = beta-D-oxy-LNA adenine nucleoside
  modified_base 4: mod_base = OTHER; note = beta-D-oxy-LNA 5-methyl cytosine nucleoside
  modified_base 5: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  modified_base 18: mod_base = OTHER; note = beta-D-oxy-LNA 5-methyl cytosine nucleoside
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
catcctttataatcacac

SEQ ID NO: 1551 - DNA, 18 bp, synthetic construct
  misc_feature 1..18: note = Description of sequence: CMP ID NO: 759_1
  source 1..18: mol_type = other DNA
  misc_feature 3..7: note = Backbone sugar is not deoxyribose
  misc_feature 16..18: note = Backbone sugar is not deoxyribose
  modified_base 3: mod_base = OTHER; note = beta-D-oxy-LNA adenine nucleoside
  modified_base 16: mod_base = OTHER; note = beta-D-oxy-LNA adenine nucleoside
  modified_base 4: mod_base = OTHER; note = beta-D-oxy-LNA 5-methyl cytosine nucleoside
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
caacggtattttcacagg

SEQ ID NO: 1552 - DNA, 18 bp, synthetic construct
  misc_feature 1..18: note = Description of sequence: CMP ID NO: 760_1
  source 1..18: mol_type = other DNA
  misc_feature 3..7: note = Backbone sugar is not deoxyribose
  misc_feature 16..18: note = Backbone sugar is not deoxyribose
  modified_base 4: mod_base = OTHER; note = beta-D-oxy-LNA adenine nucleoside
  modified_base 18: mod_base = OTHER; note = beta-D-oxy-LNA adenine nucleoside
  modified_base 5: mod_base = OTHER; note = beta-D-oxy-LNA 5-methyl cytosine nucleoside
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
cagacactacaatgagga

SEQ ID NO: 1553 - DNA, 18 bp, synthetic construct
  misc_feature 1..18: note = Description of sequence: CMP ID NO: 761_1
  source 1..18: mol_type = other DNA
  misc_feature 3..7: note = Backbone sugar is not deoxyribose
  misc_feature 16..18: note = Backbone sugar is not deoxyribose
  modified_base 3: mod_base = OTHER; note = beta-D-oxy-LNA thymine nucleoside
  modified_base 16: mod_base = OTHER; note = beta-D-oxy-LNA thymine nucleoside
  modified_base 18: mod_base = OTHER; note = beta-D-oxy-LNA thymine nucleoside
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
catggtttttaggactgt

SEQ ID NO: 1554 - DNA, 18 bp, synthetic construct
  misc_feature 1..18: note = Description of sequence: CMP ID NO: 762_1
  source 1..18: mol_type = other DNA
  misc_feature 3..7: note = Backbone sugar is not deoxyribose
  misc_feature 16..18: note = Backbone sugar is not deoxyribose
  modified_base 18: mod_base = OTHER; note = beta-D-oxy-LNA thymine nucleoside
  modified_base 5: mod_base = OTHER; note = beta-D-oxy-LNA adenine nucleoside
  modified_base 3: mod_base = OTHER; note = beta-D-oxy-LNA 5-methyl cytosine nucleoside
  modified_base 16: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
cacgacaaattctatcct

SEQ ID NO: 1555 - DNA, 18 bp, synthetic construct
  misc_feature 1..18: note = Description of sequence: CMP ID NO: 763_1
  source 1..18: mol_type = other DNA
  misc_feature 3..7: note = Backbone sugar is not deoxyribose
  misc_feature 16..18: note = Backbone sugar is not deoxyribose
  modified_base 3: mod_base = OTHER; note = beta-D-oxy-LNA thymine nucleoside
  modified_base 16: mod_base = OTHER; note = beta-D-oxy-LNA thymine nucleoside
  modified_base 5: mod_base = OTHER; note = beta-D-oxy-LNA adenine nucleoside
  modified_base 17: mod_base = OTHER; note = beta-D-oxy-LNA adenine nucleoside
  modified_base 18: mod_base = OTHER; note = beta-D-oxy-LNA 5-methyl cytosine nucleoside
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
catgatatacaatgctac

SEQ ID NO: 1556 - DNA, 18 bp, synthetic construct
  misc_feature 1..18: note = Description of sequence: CMP ID NO: 764_1
  source 1..18: mol_type = other DNA
  misc_feature 3..7: note = Backbone sugar is not deoxyribose
  misc_feature 16..18: note = Backbone sugar is not deoxyribose
  modified_base 3: mod_base = OTHER; note = beta-D-oxy-LNA thymine nucleoside
  modified_base 16: mod_base = OTHER; note = beta-D-oxy-LNA thymine nucleoside
  modified_base 17: mod_base = OTHER; note = beta-D-oxy-LNA thymine nucleoside
  modified_base 18: mod_base = OTHER; note = beta-D-oxy-LNA adenine nucleoside
  modified_base 4: mod_base = OTHER; note = beta-D-oxy-LNA 5-methyl cytosine nucleoside
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
catcgttgggtaaattta

SEQ ID NO: 1557 - DNA, 18 bp, synthetic construct
  misc_feature 1..18: note = Description of sequence: CMP ID NO: 765_1
  source 1..18: mol_type = other DNA
  misc_feature 3..7: note = Backbone sugar is not deoxyribose
  misc_feature 16..18: note = Backbone sugar is not deoxyribose
  modified_base 3: mod_base = OTHER; note = beta-D-oxy-LNA thymine nucleoside
  modified_base 17: mod_base = OTHER; note = beta-D-oxy-LNA thymine nucleoside
  modified_base 5: mod_base = OTHER; note = beta-D-oxy-LNA 5-methyl cytosine nucleoside
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
catgctttataaatggtg

SEQ ID NO: 1558 - DNA, 20 bp, synthetic construct
  misc_feature 1..20: note = Description of sequence: CMP ID NO: 766_1
  source 1..20: mol_type = other DNA
  misc_feature 3..8: note = Backbone sugar is not deoxyribose
  misc_feature 17..20: note = Backbone sugar is not deoxyribose
  modified_base 18: mod_base = OTHER; note = beta-D-oxy-LNA thymine nucleoside
  modified_base 20: mod_base = OTHER; note = beta-D-oxy-LNA thymine nucleoside
  modified_base 3: mod_base = OTHER; note = beta-D-oxy-LNA adenine nucleoside
  modified_base 5: mod_base = OTHER; note = beta-D-oxy-LNA adenine nucleoside
  modified_base 6: mod_base = OTHER; note = beta-D-oxy-LNA adenine nucleoside
  modified_base 4: mod_base = OTHER; note = beta-D-oxy-LNA 5-methyl cytosine nucleoside
  modified_base 17: mod_base = OTHER; note = beta-D-oxy-LNA 5-methyl cytosine nucleoside
  modified_base 19: mod_base = OTHER; note = beta-D-oxy-LNA 5-methyl cytosine nucleoside
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
caacaaataatggttactct

SEQ ID NO: 1559 - DNA, 18 bp, synthetic construct
  misc_feature 1..18: note = Description of sequence: CMP ID NO: 767_1
  source 1..18: mol_type = other DNA
  misc_feature 3..8: note = Backbone sugar is not deoxyribose
  misc_feature 17..18: note = Backbone sugar is not deoxyribose
  modified_base 17: mod_base = OTHER; note = beta-D-oxy-LNA thymine nucleoside
  modified_base 18: mod_base = OTHER; note = beta-D-oxy-LNA thymine nucleoside
  modified_base 4: mod_base = OTHER; note = beta-D-oxy-LNA adenine nucleoside
  modified_base 6: mod_base = OTHER; note = beta-D-oxy-LNA adenine nucleoside
  modified_base 3: mod_base = OTHER; note = beta-D-oxy-LNA 5-methyl cytosine nucleoside
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
cacagattgatggtagtt

SEQ ID NO: 1560 - DNA, 19 bp, synthetic construct
  misc_feature 1..19: note = Description of sequence: CMP ID NO: 768_1
  source 1..19: mol_type = other DNA
  misc_feature 3..6: note = Backbone sugar is not deoxyribose
  misc_feature 16..19: note = Backbone sugar is not deoxyribose
  modified_base 16: mod_base = OTHER; note = beta-D-oxy-LNA adenine nucleoside
  modified_base 18: mod_base = OTHER; note = beta-D-oxy-LNA adenine nucleoside
  modified_base 3: mod_base = OTHER; note = beta-D-oxy-LNA 5-methyl cytosine nucleoside
  modified_base 4: mod_base = OTHER; note = beta-D-oxy-LNA 5-methyl cytosine nucleoside
  modified_base 19: mod_base = OTHER; note = beta-D-oxy-LNA 5-methyl cytosine nucleoside
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
cacctatttaacatcagac

SEQ ID NO: 1561 - DNA, 20 bp, synthetic construct
  misc_feature 1..20: note = Description of sequence: CMP ID NO: 769_1
  source 1..20: mol_type = other DNA
  misc_feature 3..7: note = Backbone sugar is not deoxyribose
  misc_feature 18..20: note = Backbone sugar is not deoxyribose
  modified_base 4: mod_base = OTHER; note = beta-D-oxy-LNA thymine nucleoside
  modified_base 19: mod_base = OTHER; note = beta-D-oxy-LNA thymine nucleoside
  modified_base 5: mod_base = OTHER; note = beta-D-oxy-LNA adenine nucleoside
  modified_base 3: mod_base = OTHER; note = beta-D-oxy-LNA 5-methyl cytosine nucleoside
  modified_base 18: mod_base = OTHER; note = beta-D-oxy-LNA 5-methyl cytosine nucleoside
  modified_base 20: mod_base = OTHER; note = beta-D-oxy-LNA 5-methyl cytosine nucleoside
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
cactaattgtagtagtactc

SEQ ID NO: 1562 - DNA, 20 bp, synthetic construct
  misc_feature 1..20: note = Description of sequence: CMP ID NO: 770_1
  source 1..20: mol_type = other DNA
  misc_feature 3..6: note = Backbone sugar is not deoxyribose
  misc_feature 17..20: note = Backbone sugar is not deoxyribose
  modified_base 4: mod_base = OTHER; note = beta-D-oxy-LNA thymine nucleoside
  modified_base 18: mod_base = OTHER; note = beta-D-oxy-LNA thymine nucleoside
  modified_base 3: mod_base = OTHER; note = beta-D-oxy-LNA adenine nucleoside
  modified_base 17: mod_base = OTHER; note = beta-D-oxy-LNA 5-methyl cytosine nucleoside
  modified_base 19: mod_base = OTHER; note = beta-D-oxy-LNA 5-methyl cytosine nucleoside
  modified_base 20: mod_base = OTHER; note = beta-D-oxy-LNA 5-methyl cytosine nucleoside
  misc_feature 3^4: note = phosphorothioate internucleoside linkage
  misc_feature 4^5: note = phosphorothioate internucleoside linkage
  misc_feature 5^6: note = phosphorothioate internucleoside linkage
  misc_feature 6^7: note = phosphorothioate internucleoside linkage
  misc_feature 7^8: note = phosphorothioate internucleoside linkage
  misc_feature 8^9: note = phosphorothioate internucleoside linkage
  misc_feature 9^10: note = phosphorothioate internucleoside linkage
  misc_feature 10^11: note = phosphorothioate internucleoside linkage
  misc_feature 11^12: note = phosphorothioate internucleoside linkage
  misc_feature 12^13: note = phosphorothioate internucleoside linkage
  misc_feature 13^14: note = phosphorothioate internucleoside linkage
  misc_feature 14^15: note = phosphorothioate internucleoside linkage
  misc_feature 15^16: note = phosphorothioate internucleoside linkage
  misc_feature 16^17: note = phosphorothioate internucleoside linkage
  misc_feature 17^18: note = phosphorothioate internucleoside linkage
  misc_feature 18^19: note = phosphorothioate internucleoside linkage
  misc_feature 19^20: note = phosphorothioate internucleoside linkage
caataaacatgaatctctcc

The invention claimed is:

1. An antisense oligonucleotide conjugate of formula GN2-C6$_o$c$_o$a$_o$CTAattgtagtagtaCTC(SEQ ID NO. 466), wherein C6 represents an amino alkyl group with 6 carbons, capital letters represent beta-D-oxy LNA nucleosides, lowercase letters represent DNA nucleosides, all LNA C are 5-methyl cytosine, subscript o represents a phosphodiester nucleoside linkage and unless otherwise indicated, all internucleoside linkages are phosphorothioate internucleoside linkages, and wherein GN2 represents the trivalent GalNAc cluster of formula further wherein the wavy line illustrates the site of conjugation of the cluster to the C6 amino alkyl group.

2. A pharmaceutical composition comprising the antisense oligonucleotide conjugate of claim 1 and a pharmaceutically acceptable diluent, solvent, carrier, salt and/or adjuvant.

3. The pharmaceutical composition according to claim 2 wherein the pharmaceutically acceptable diluent is sterile phosphate buffered saline.

4. The pharmaceutical composition according to claim 2 wherein the pharmaceutically acceptable salt is sodium or potassium.

5. An in vivo or in vitro method for modulating PD-LI expression in a target cell which is expressing PD-LI, the method comprising administering the antisense oligonucleotide conjugate of claim 1 in an effective amount to the cell.

6. A method for treating or preventing a disease comprising administering a therapeutically or prophylactically effective amount of the pharmaceutical composition of claim 2 to a subject suffering from or susceptible to the disease.

7. A method for treating or preventing HBV infection comprising administering a therapeutically or prophylactically effective amount of the pharmaceutical composition of claim 2 to a subject suffering from or susceptible to HBV infection.

8. A pharmaceutically acceptable salt of the antisense oligonucleotide conjugate of claim 1.

9. A pharmaceutically acceptable sodium salt of the antisense oligonucleotide conjugate of claim 1.

10. A pharmaceutically acceptable potassium salt of the antisense oligonucleotide conjugate of claim 1.

\* \* \* \* \*